United States Patent 7,745,391 (HUMAN THROMBOSPONDIN POLYPEPTIDE) - sequence listing, part 261

SEQ ID NO: 735340 - DNA, 188158 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735341 - DNA, 187842 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735342 - DNA, 187679 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735343 - DNA, 187583 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735344 - DNA, 1615 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactgtcctgtaaggttgaaatttggggccagtacctccctacacacacacacacacacacacacacacacacacgcacgctgtcctgtacctccctacacacacgcacacgctgtctgtacctccctacacacacacacacacacacacacgctgtccttatactggcttatctccctatacacacacacacacacacacacacgctgtcctgtac

SEQ ID NO: 735345 - DNA, 2303 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735346 - DNA, 2260 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735347 - DNA, 2139 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735348 - DNA, 2182 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735349 - DNA, 2284 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735350 - DNA, 2176 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735351 - DNA, 2133 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735352 - DNA, 2012 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735353 - DNA, 2055 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735354 - DNA, 2157 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735355 - DNA, 1841 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735356 - DNA, 1678 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735357 - DNA, 1582 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735358 - DNA, 2140 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735359 - DNA, 2097 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735360 - DNA, 1976 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735361 - DNA, 2019 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735362 - DNA, 2121 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735363 - DNA, 2013 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735364 - DNA, 1970 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735365 - DNA, 1849 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735366 - DNA, 1892 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735367 - DNA, 1994 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735368 - DNA, 1678 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735369 - DNA, 1515 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735370 - DNA, 1419 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735371 - DNA, 1534 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactgtcctgtaaggttgaaatttggggccagtacctccctacacacacacacacacacacacacacacacacacgcacgctgtcctgtacctccctacacacacgcacacgctgtctgtacctccctacacacacacacacacacacacacgctgtccttatactggcttatctccctatacacacacacacacacacacacacgctgtcctgtac

SEQ ID NO: 735372 - DNA, 2222 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735373 - DNA, 2179 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735374 - DNA, 2058 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735375 - DNA, 2101 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735376 - DNA, 2203 bp, Homo sapiens
gtaagtgaccggagttcctagagccccaaatttgaagtccgctctacagcctccgcattcagggcctctgttggcggccacgagagcagaaagccgtgaggcagcaggctaagcctggcaagccccgtactgggagtgcaaacctgtggctagtgggggccaggaaggatctgtgagggtcgcaggcggaggagacgctttagcgagcgagaggaggcagggacttggctgagagtatccaatggggatgagggagtggctgccgaagagcgacgcgactaaccaatcagagggagggatgacacaaggagctaatggacaggcaagggtggggcctgtaggataagagagcttggaagggattgttcgaggatgtgggatttggtcttagaagaccgaagatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735377 - DNA, 1178 bp, Homo sapiens; identical to SEQ ID NO: 78283
  misc_feature (1091)..(1091): n is a, c, g, or t
  misc_feature (1123)..(1123): n is a, c, g, or t
  misc_feature (1127)..(1128): n is a, c, g, or t
  misc_feature (1131)..(1131): n is a, c, g, or t

SEQ ID NO: 735378 - DNA, 232 bp, Homo sapiens
ctgtgcttctgtgcattattctgagaataaatttctgtttcaaactgtataaaaaaaaaaaaaacacaacacagaaagagcgacacaccaaaaaaacacagaggacaagacaaagcagcgaaaacacacccaaagggggcgcacaccatagacaggcgcacaaaaaaaaaataccggcggtgtggtaaaaaaacagacagagggaggaaaaacacaagggggtaacacacaa

SEQ ID NO: 735379 - DNA, 3000 bp, Homo sapiens; identical to SEQ ID NO: 447184

SEQ ID NO: 735380 - DNA, 3488 bp, Homo sapiens; identical to SEQ ID NO: 299989

SEQ ID NO: 735381 - DNA, 2987 bp, Homo sapiens; identical to SEQ ID NO: 299990

SEQ ID NO: 735382 - DNA, 2332 bp, Homo sapiens; identical to SEQ ID NO: 299994

SEQ ID NO: 735383 - DNA, 2708 bp, Homo sapiens; identical to SEQ ID NO: 367150

SEQ ID NO: 735384 - DNA, 2557 bp, Homo sapiens; identical to SEQ ID NO: 367151

SEQ ID NO: 735385 - DNA, 2502 bp, Homo sapiens; identical to SEQ ID NO: 367152

SEQ ID NO: 735386 - DNA, 2488 bp, Homo sapiens; identical to SEQ ID NO: 367142

SEQ ID NO: 735387 - DNA, 2346 bp, Homo sapiens; identical to SEQ ID NO: 367143

SEQ ID NO: 735388 - DNA, 1755 bp, Homo sapiens; identical to SEQ ID NO: 367154

SEQ ID NO: 735389 - DNA, 2402 bp, Homo sapiens; identical to SEQ ID NO: 349322

SEQ ID NO: 735390 - DNA, 3113 bp, Homo sapiens; identical to SEQ ID NO: 349344

SEQ ID NO: 735391 - DNA, 2348 bp, Homo sapiens; identical to SEQ ID NO: 349324

SEQ ID NO: 735392 - DNA, 2348 bp, Homo sapiens; identical to SEQ ID NO: 349324

SEQ ID NO: 735393 - DNA, 2316 bp, Homo sapiens; identical to SEQ ID NO: 349327

SEQ ID NO: 735394 - DNA, 2153 bp, Homo sapiens; identical to SEQ ID NO: 349350

SEQ ID NO: 735395 - DNA, 2056 bp, Homo sapiens; identical to SEQ ID NO: 349332

SEQ ID NO: 735396 - DNA, 2049 bp, Homo sapiens; identical to SEQ ID NO: 349351
  misc_feature (30)..(31): n is a, c, g, or t
  misc_feature (33)..(33): n is a, c, g, or t
  misc_feature (35)..(35): n is a, c, g, or t

SEQ ID NO: 735397 - DNA, 2349 bp, Homo sapiens; identical to SEQ ID NO: 349333

SEQ ID NO: 735398 - DNA, 2081 bp, Homo sapiens; identical to SEQ ID NO: 349334

SEQ ID NO: 735399 - DNA, 1710 bp, Homo sapiens; identical to SEQ ID NO: 349353

SEQ ID NO: 735400 - DNA, 1493 bp, Homo sapiens; identical to SEQ ID NO: 349335

SEQ ID NO: 735401 - DNA, 1358 bp, Homo sapiens; identical to SEQ ID NO: 349336
  misc_feature (30)..(31): n is a, c, g, or t
  misc_feature (33)..(33): n is a, c, g, or t
  misc_feature (35)..(35): n is a, c, g, or t

SEQ ID NO: 735402 - DNA, 1947 bp, Homo sapiens; identical to SEQ ID NO: 349354

SEQ ID NO: 735403 - DNA, 1978 bp, Homo sapiens; identical to SEQ ID NO: 349337

SEQ ID NO: 735404 - DNA, 1605 bp, Homo sapiens; identical to SEQ ID NO: 349355

SEQ ID NO: 735405 - DNA, 851 bp, Homo sapiens; identical to SEQ ID NO: 349356

SEQ ID NO: 735406 - DNA, 1152 bp, Homo sapiens; identical to SEQ ID NO: 349339

SEQ ID NO: 735407 - DNA, 1101 bp, Homo sapiens; identical to SEQ ID NO: 349340

SEQ ID NO: 735408 - DNA, 1018 bp, Homo sapiens; identical to SEQ ID NO: 349357

SEQ ID NO: 735409 - DNA, 1981 bp, Homo sapiens
tttaagagatggaggcctcactctatcatccaggctggagtgcagtgctaagatcctagctcactgtaaccttaaaatattttttttgtagagactgtgtctcgctttgttgcccaggctggtcttgggctccttgcctcaagtgattctcctgcctcactcttccccaaaatttttgaaatagatttctttgcatatgagattttagtatataatggcactattatttcaatatcgggaaaattatgttttgacaattggttatccaccctctccaagaaaaaagttagaagcacatttacaccttacagagaaatatgactatcatatttgacatatctaatcataaaataacatgttagaggcaaatgtagaaaaaaggaacgtattatcaagtaggacatggagtcctagaagccataaagaaatcgagaacaagttgggctatgcaacgatctaaaacttcagcatggtgaaaggcaccaaaaacttgtaaaagacagttgaagggaaatgtatacaacttatagaaaataacagaatgctgttacatatacagagcagtggggaacaacttgccatgcacactgataggcgaatcaccctgaagaatccaaatggataaagaaaattcgtgaaattcttaacctcattaatcagaagaatatgaatgaaaccacattttcctggctcttggtagattacaatataaaatttggataatatccagtaatggtattagtgtgggaaaacaggtacttgatcactattagcagtgtaacttcgtcccctatctcctcggatggcatgacctatcaacattataaacgtgaatttttttcaaacagtaattccagatctaggaattttatcccattggaataaataggtagatataaatattgttttcttgtagaattgtttcaattatgacaaataagaattcagcgccctgccaagtggattgactaaattgtagttattcagtactgtgttgtgcgattagtagaaagcagttaagctctacatacacttctatggagtggcgtctacaacatatttaatgaaatatgtggtttacagaaccttacaggtaaaatgacctagtcatagagtcaaaattaatactgaatatatatgtgtgtatgtacatacaaacacatgcacagcctcagtatctatgttgaaatctggttttgtctttaacacacagacttttcctagcattttgcgggcactttccctttcttcattctgtattgttctgatgaactgtcagtgacacatgctccaagtaagacaaccagattcattctctgtattttgattagagacacagggacaggaacagggccaatattcagctttatgaaccagtatggccagaatggatgttttgttttagtcaatattcattttgattggtgggacctttattatacctgctgtgaagtatgtgggatatgactcctaggctggaattcgtttgaattaagtcatcctttggcagcaacctaaggattcctccacctgtcactgagatccattgagatgattcctgctttctcacatcttggttttgagttaaattctttgagtctgtgaactacctggtattctaatatttctcattttaagtcagagtcaaatactttggttctcaagcaaagagagctagccaatgcagaaatttatactacagaatgattactagactgtagagaagcagagtattcaagatggatgtccagtgagacagatcaaagcacagatgaattcctaatcctattttgtgctgtgaaaggatattcatgatatagcaggatcctaagcccattgtgcactagggtctggatagctcctaccaaaaacaaaggtattgaggaatactacttccaaaagtatatatgatacctgtttataatgaaattgggtaattaaaatttcaaggctacttgaaattctggccttaaggaattga

SEQ ID NO: 735410 - DNA, 1725 bp, Homo sapiens
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggtattgttcttagctgagcagattgcttcctgaggtgcatctctctctgcaccagtaacaccttggattgaatgtccattgagtaagcttctgttgtgtttgatgagctaatttaccaaccatttagaccttctgttctgactgaagcatcctatggcattcagaccaattttctgaaactttccatttgtacctgacatgagctttattgaaactggttgtcttttctttcctgatggctttcctaagggtcttcaagtgagttgtggtggctttgcagccagtaggcttgtcctttaaaaggccagccaaaattcctcagggatctagaactagaaataccatttgacccagccatcccattactaggtgtatacccaaaggattataaatcatgctgctataaagacacatgcacacgtatgtttattgaggcactattcacaatagcaaagacttggaaccaacccaaatgtccaacaacgataaactggattaagaaaatgtggcacatatacaccattgaatactatgcagccataaaaaatgaagagttcatgtcctttgtagggacatggatgaaactggaaaccatcattctcagcaaactatcacaaggacaaaaaaccaaataccacatgttctcactcataggtgggaattgaacaatgagcacacatggacacaggaaggggaacatcacactccggggactgttgtggggtggggggagcggggagggataacattgggagatatacctaatgctaaatgacgagttaatgggtgcagcacaccagcatggcacatgtatacatatgtaacaaacctgcacattgtgcacatgtaccctaaaacttaaagtataataataaaaaaaaaaaaggccagccaaaaggatgagatttcagtggtcatcgcaatcctattttaagacaaagagagagtatgtgactctaatgattcaataaactcttcctcattgcttagaggaaacactaaggagtagt

SEQ ID NO: 735411 - DNA, 1322 bp, Homo sapiens
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagagggcagcatgttgacttcagttaagttttacctggttgggtggattccattgtcatcggtgtcttctggctctcagggcctttctggaacctgaagctgttggcaacatctgtgctgtccaccctgctctgagtctgctgcagatgtgttgaaaaggtgactctctccactgggaaaatgaaaaactttatgaccggcaacatcatttttacagccaagtgaactcctttgataaaatattcctcttttctgagcttatttccttcctgtgtgtaaagaggggtttgggcagattgtaagctttctctcagctctttgcatctatgttatcacacttcctcactatacagaaataaatatccttattgcc

SEQ ID NO: 735412 - DNA, 479 bp, Homo sapiens
ctgaggaggcagaggacggcccggagtctcgtagcgcaccgccctggtcccacaccccccgcagccctaggaggatcggtgtgctgagcttgtggccaggagctccccgagccactttcgcgcgagcagcagaaaacctgagccgcggcccggcgagtgtcggcggcgctctggggaggagaggctgggaaggggctgcgagagatgctacttaagaacgtgaggctgagaggcggacttggtcagatctgcctgcgtgacaagctcaggacaggacgcttctgcccttgcattactgttgtaaaagtttccacccagtccctggtcgcactgcgttcccatcccggcagatgtgaactcaaaaacttcctccgctgtgcagtttcaattggcagacacaccctgtacctgaatgactcagaaggaggcagaatgaacaaacaacagacccctgacttctgggattttgtgagtttgcc

SEQ ID NO: 735413 - DNA, 272 bp, Homo sapiens
gcggccgcctcgggtcctgacgtcgggcgccctccggccgtcactcagcgctcggccccgccccgccgcggctgccgcagcagcgccgcggccggaggagctaccgccgccaccgccgccaccgcctcctgggactcggaacgcagcgctcggagccatggcctcggcccccgcgggtaagaggccgctggacacgagggcggcgggagggcagcgcccggcccccgcaccctctctcggctgacccgcggctctcgtttcttgtcccacag

SEQ ID NO: 735414 - DNA, 299 bp, Homo sapiens; identical to SEQ ID NO: 187317

SEQ ID NO: 735415 - DNA, 241 bp, Homo sapiens
tcaactcggttcttcttgactttgtcctgtagtcccgtcagaggtggatggtggatgagatgagagagactcaggggaggtaaaaactgctcctgacctttgcccaggactttcccagagcctcagagcaggatccctgggtctggcttggcacccctgggggatgtgcttgcaggaaggggctgtcaccgtgcctcatagtgacttccactgggtcttctctggctggtggtggcggcag

SEQ ID NO: 735416 - DNA, 319 bp, Homo sapiens; identical to SEQ ID NO: 249700

SEQ ID NO: 735417 - DNA, 481 bp, Homo sapiens
gcggccgcctcgggtcctgacgtcgggcgccctccggccgtcactcagcgctcggccccgccccgccgcggctgccgcagcagcgccgcggccggaggagctaccgccgccaccgccgccaccgcctcctgggactcggaacgcagcgctcggagccatggcctcggcccccgcggaggcggagacccgacagaggctgctacgcaccgtcaagaaggaggtctctggcaacctggcttctgggagcttttgctagtgatgagcatctgtggcagcttaggcaccctggttcgatgtggtcccttctcaaggtctcactttcctgctttctaagtggacgaggttggacagctccaggattccaagaacctcaactcatctaatttggccagtgtcactctctgagagccaagtctttgttttttccactctgaatttgccaagtatttattcaagactaattaaaactaagtagctggta

SEQ ID NO: 735418 - DNA, 2479 bp, Homo sapiens
gtccggattcctcgatgcgcaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgag

SEQ ID NO: 735419 - DNA, 2406 bp, Homo sapiens
gtccggattcctcgatgcgcaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgaggtgatgggcggctggcctcggggagcgcgggggctggggaaggtcagggtctgcttcattgggctgttctaagagtggtgaagactgggtgtctggggcctggtgacagtctcacccctggctttttctttaagagtgtgcggtgactttggaatcagacctgaattcaaactctagtcccaccatttagtagttctggggttccctaccagtaccttttcttctgggcctcagttttctgcatctgtaaaatgggaataatcaggtgtagaggaggttcgtgtacagtccaaacaagacaatgtatataaagtgcctggcgcactgcctgactttcattgattcaacaaatgcttattgagtatctactatgtgcaggtactatcaggaatatcc

SEQ ID NO: 735420 - DNA, 2284 bp, Homo sapiens
gtccggattcctcgatgcgcaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagc

SEQ ID NO: 735421 - DNA, 1972 bp, Homo sapiens
taggttaaaatcttcattgtagaaagtttttaggaaagcaataaaatgtaaaataagattcgatgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgaggtgatgggcggctggcctcggggagcgcgggggctggggaaggtcagggtctgcttcattgggctgttctaagagtggtgaagactgggtgtctggggcctggtgacagtctcacccctggctttttctttaagagtgtgcggtgactttggaatcagacctgaattcaaactctagtcccaccatttagtagttctggggttccctaccagtaccttttcttctgggcctcagttttctgcatctgtaaaatgggaataatcaggtgtagaggaggttcgtgtacagtccaaacaagacaatgtatataaagtgcctggcgcactgcctgactttcattgattcaacaaatgcttattgagtatctactatgtgcaggtactatcaggaatatcc

SEQ ID NO: 735422 - DNA, 1724 bp, Homo sapiens
atctcagggaggaaggagctggggatttgaattcctgggcctgaggaatgagggtctgagacgaggactcctgggtctgaaggaagagggagctgggggcaatggctccgatgaggaaccctatgggcacccgctgagcaccggctacccgtagctctccggccgctggggccgggtgttcacagtgcggctgggcccgcgccctgcggtggggctgtgcggctacgcagcgctgcgggacgcgttagtgctacaggcggatgcggtctctggccgcgggtccatggcagtcttcgaacgcttcacacgcggaaacagtgaggccccggcgctggacttgccggcccggacgctccaggctgggcgggtaaatggtagaggcgggcaaatgggggcggggcctaatagagactccagctaatgaggtgcaaacggccgagagagggcggggcggcgctaaagcgtaaggttagaatggaggttcatcctgcagccaacaggagaaaagagcctaagagtcaaagcccgagagccagcctaggtcagggatggagcccagcaaaggcggggccaatgtgtggatagggcacttggaggtctggtaaagaagcaaagggaacgaagccggccgcaggagtcggaggcccctaaagggatgtagccagtgacccggcgcttcctggatagggcgtggccggctcccgggcccgcctcctttcccgtccccaccacaggaatcttgttttctaaccggccgtgctggtggacactgcgcaattttgcacttggagcgcttaagaagttcgggttgggtacgcggaccgtcgaggcgcgcgtcctggaggaggcggcttgtctgctagacgaatttcaagccaccattgcttcggcctggccgggagagcggaagggcctggtgtgggagagtcccttgcactgccaagacggggccactggaaggtatttgggtggaagaaagccagtaagcccatggggctggctgggggcaggaccacgcgttatgaccaccgtcctgttcctacccccaggagccccgtttgaccccgtgcggctactggataatgctgtatccaatgttatctgttcttgtcttcgggaaccgctatcgctatggggacccggagttcctgaggctcctgaacctcttcagtgacaacttctgcatcattagttccagatggggcgaggtgagagggccggccacaatctttccttggtgcgtccagccttatgccaaatcccgagtacacagacctacctacaatggatcattagaatgggacagattcctggaagagttctagaacatccagtatcaaagtcctagtccaatctccctgtagggaaactaaggcctagtggccttgtgcagggcccatgttgagacagaccctgtctctccagatgtacatttgcctgtccctcatggactggctcccgggcccgcaccaccgaatcttccgaaacttttcggagctgcgggtcatctctgagcaaattcaacgacactggcagatgcggcagccagcggagccccgcgatttcattgattgcttgaccagatgggtaaggcatgggtcccagctctctaaactctatccatgccgcccaccaacaggtgcctggcacgcggcagacatctccttctgcccacagtaacagcaggacccggaaagccatttccaggagtagacgtcggtaat

SEQ ID NO: 735423 - DNA, 882 bp, Homo sapiens
ttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacgtctgtggttggaacaatcctgtattcttgtggtttcatgagaagatgcaaagaaactgtggcaggctaacatgtaccttgtaagctgcaagcttatatgatgtctacttatcctcttaacagtaaggctgacctactcgttactttctgagagaagaataattttcttttgtttcactgtgtactgtttttataaaataaacaataaaatttgatcataaaa

SEQ ID NO: 735424 - DNA, 668 bp, Homo sapiens; identical to SEQ ID NO: 77517

SEQ ID NO: 735425 - DNA, 744 bp, Homo sapiens
ttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacgtctgtggttggaacaatcctgtattcttgtggtttcatgagaagatgcaaagaaactgtggcaggctaacatgtaccttgtaagctgcaagcttatatgatgtctacttatcctcttaacagtaaggctgacctactcgttactttctgagagaagaataattttcttttgtttcactgtgtactgtttttataaaataaacaataaaatttgatcataaaa

SEQ ID NO: 735426 - DNA, 1558 bp, Homo sapiens
taggagtcctgaaaagggactatatcgtctgcatcttggctctgaaccctgaggtccaaggctgaaaggaattgtgagcaggggagggtctgagttctggctctgtcttcaccctattgggctggtgaggcccagggagggtgggagcccagtcactggtccaagccaccaattggaccatgtgatcatgaggcccagagagaatgtgggtggcataaaagccacagagcaagccaggagcagagccagggctggacagcaccccaccctcccctgccactgttcctcccaccaggcgcttcccaactgcctgcgggatctggactaaacggagcccagggtttaagcaccccatattgaggaccggggcctccaggttacttgtgccagttatgagggtaggactgggatcctggttcacagtgactgctatgacccctgccctgcctcacccctgcagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagctcacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcacttcatgtcctgtgtcttgggctgtgtgtggattggatggggtgagggtacggccattgtcctcttcttaacgggaat

SEQ ID NO: 735427 - DNA, 1017 bp, Homo sapiens
taggagtcctgaaaagggactatatcgtctgcatcttggctctgaaccctgaggtccaaggctgaaaggaattgtgagcaggggagggtctgagttctggctctgtcttcaccctattgggctggtgaggcccagggagggtgggagcccagtcactggtccaagccaccaattggaccatgtgatcatgaggcccagagagaatgtgggtggcataaaagccacagagcaagccaggagcagagccagggctggacagcaccccaccctcccctgccactgttcctcccaccaggcgcttcccaactgcctgcgggatctggactaaacggagcccagggtttaagcaccccatattgaggaccggggcctccaggttacttgtgccagttatgagggtaggactgggatcctggttcacagtgactgctatgacccctgccctgcctcacccctgcagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgcacttcatgtcctgtgtcttgggctgtgtgtggattggatggggtgagggtacggccattgtcctcttcttaacgggaat

SEQ ID NO: 735428 - DNA, 777 bp, Homo sapiens
ttaactttaacagaccgcaccaaccagcagttcctcagcgctttgccagccttcctccaaaagtccgggaagctgaaagtccccggacgggtggataccgtcaagctggccaagcacaaagagcttgctcctacggatgagaactgcttctacgacgcgagctgcttccacagcgcggcacctgtacctccggggtggcgctggagttggctccatgaccaagatctatgggggacgtcagagaaacggcgtcatgcccagccacttcagccgaggctccaagagtgtggccgccgggtcctccacagcctggaggggctgaaaatggtggaaaaggaccaatgatgcggccgccaattttttttcttcttcttttttttgtgtctgtggaggtcagcgtcagagcacgctgctgagaggtctgagtcctgctgatgcctggagtcgcggtctcggtgtttgtctttggatttctttttcttctttgattttttgtgcttctttgctttaggctcttctagaggatccttctgttcgctcctccgggctttcttttcaacatgactgtcactgttctccacactgtcgtgtctccgtttccgggactttccattttcgtgttcgtgaaaccgatcagagaggttacagttgtctccggctacaagtgcagttctgtcgtgggagaagcggtcggggtgcggggcgagggcgtggggcgcgcctgcgcgggggctgctggggcggtgccgctccctctcccgggccggctcgcagccc

SEQ ID NO: 735429 - DNA, 12372 bp, Homo sapiens
cccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccagaggctcacagttggtgtgtctctcccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtccaggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcagccctatccttccacgtgccccacccccaccatcagaccccctgttccaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctgggagcttgtctatgcccctggtgcctgtctcctcacctgtgacagccccagcgccaatcactcctgccctgcaggcagtactgatggctgtgtctgtccaccaggcacggtgctgctggacgagcgctgtgtgcctcctgacctctgtccctgccgtcacagtgggcagtggtacctgcccaacgccaccatccaggaagactgcaacgtttgcgtgtgccggggccggcagtggcactgcacaggccagcggcgcagtgggcggtgccaggcatcaggcgccccccactatgtgacatttgacggactggccttcacctatcctggggcctgcgagtatctgctggtgcgagaggccagtggcctattcacagtctctgcccagaacctgccctgtggggccagcggtctcacctgcaccaaagcgctggccgtgcgtctggagggcactgttgtgcacatgctcagagggactcgggtcctggtgcaactgtcccctcagttccgtggtcgcgtggctgggctgtgtggtgactttgatggagatgccagtaatgatctgcggagccgccagggcgtcctggagcccacagctgaactggctgcccactcctggcgcctcagccccctctgccctgagccaggagacctgccacacccctgcacgatgaacacacaccgggctggttgggctcgggcccgctgtggggcgctgctgcagccgctcttcacattatgccacgcggaggtccccccgcagcagcactatgagtggtgcctgtatgacgcctgcggctgcgactcggggggtgactgtgagtgcctctgctcggccattgccacctatgcagatgagtgtgcccggcatgggcaccacgtgcgctggcgtagccaggagctctgctgtctacaccagacaccctgtgccctccatggtggtcaccttggccagccagcctggtgtggttgcatccttttgcccttgtgcctcagtgatccaaggctctctcctctccacccagccctgcagtgtgaagggggacaggtatatgaggcctgtggccccacgtgtccccccacctgccatgagcagcatcctgagcccgggtggcactgccaggtggtggcctgtgtggagggctgcttctgccccgaggggactctgctgcacggacgctgtgtgctcagcacgtgccaggaaggtcaatggcattgtgggggtgacggtggccactgtgaggagcttgtgcctgcctgtgcagagggagaggccctgtgccaagagaatgggcactgtgtgccccatgggtggctttgtgacaaccaggacgactgtggcgatggctctgatgaggagggtgagtgtctttgcccatgcgtggaagcgacagggttggtcagtccttgcacatgttgtgccgccccaggctgtggggaggggcagatgacttgcagctccggccactgcctgcccctggccctgctctgtgaccgccaggatgactgtggagatggcacggatgagccgagctatccgtgcccccagggcttgctggcctgtgccgatggacgctgcctgccgccggccctgctctgcgatgggcatcctgactgtctggatgccgccgacgaggagtcctgtctggggcaggtgacctgcgtccccggggaggtgtcctgtgttgatggcacctgcctgggggccatccagctgtgtgacggagtctgggactgcccagatggagccgatgaggggccgggacactgccccctaccttctctgcccacacctcctgccagcaccttgcctggcccctccccaggctccctggacactgcgtcaagtcccctggccagcgccagccctgcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcgttgaggctcccgcgcccccggccatgcgcggcccccctggccaagccggcgggcccacctcttcccgagcgccatccccaccttcgcctcctgaggcacagggagagggcaggaagggacaggagcggagcaggacacatctcacagtgcccgcaggctccacccagctgcctctgtgccctggcctctttccctgtggtgtggctccggggctgtgcctgacccctgagcagctctgtgatgggatcccagactgtccccagggcgaggacgagctggactgcggggggctgccagccctgggaggccccaacaggacagggcttccctgcccagaatacacctgccccaatggcacctgcataggcttccagctggtgtgtgatgggcagcctgactgtggaaggccagggcaggtgggcccctccccagaagagcagggttgtggggcctggggcccctggagcccatgggggccctgcagccggacgtgtgggccctggggccagggccggagccgccgctgctccccactcggcctcctggtgctacagaactgcccagggcctgagcaccagtctcaggcctgcttcacggcagcctgcccagtggacggtgaatggagcacctggtccccctggtctgtgtgctctgagccgtgcaggggcaccatgacgcggcaacggcagtgccactcaccccagaatgggggccgcacctgtgctgcactgcccggaggcctgcacagcacccgccagaccaagccttgccctcaggacggctgccccaatgccacttgctctggggagctgatgttccagccctgtgccccctgcccactgacctgtgatgacatctctggccaggtcacgtgcccacctgattggccctgcggcagcccgggctgctggtgcccagaagggcaggtgctgggcagcgaggggtggtgtgtgtggccccggcagtgcccctgcctggtggacggtgcccgctactggcctgggcaacgcatcaaggccgactgccagctctgcatctgccaagacggacggccccgacgctgccgactcaacccggactgcgctggtgaggcccttccctcggggtccctagtcctctccctggaccgcccagctgcacatccaccacctccttcaggctctgactgttggccctccctcagtggactgtggctggtcctcctggtcaccctgggccaagtgcctgggcccctgtggaagccagagcatccagtggtccttccggagctccaacaacccccgcccctccggccgaggtcgccagtgccgtggcatccaccgcaaggcacgcagacggagccctgtgaggggtgtgagcatcagggccaggtccaccgtgtcggggaacgctggcatgggggcccctgcagggtgtgccagtgtctgcacaacctcaccgcacactgctcaccctactgcccgctcggcagctgcccccagggctgggtcttggtggaggggacgggagaatcatgctgccactgtgccctacctggagagaaccagacggtccagcccatggccactcctgccgcagctccggctcccagtccccagatcagattccctttggccacttacattctgcctccgtcaggaggctcctgccgccctctgtcctcccctactccagcctgtctctctcttctgcacccagacccctgctattctcccctggggctggccggactggctgaggggagtctgcatgcatcgtcccagcagctggaacaccccacccaggctgccctcctgggggctcccacccaggggcccagccctcagggatggcacgctggaggggatgcttatgccaagtggcacactcggccccattacctgcagctggacctgcttcagcctcggaacctcactggcatcctagtgccggagactggctcctccaacgcatatgccagcagcttctcactccagttcagcagcaatggtctacactggcatgactatcgtgacctcctgcctggcatcttgcccctgcccaaggtatcacccgcccaaggccgatggggccagcagcccaccatgcccttttgtgggttccatagtctttgtccccaagggccttccagtgtccccgaggggcatggcctgcattcgatgcttgttgaatacctgcttttccccagaaactgggatgacctggaccctgccgtatggactttcggccgcatggtgcaggcgaggtttgtcagggtgtggccccacgatgtccaccacagcgatgtccccctgcaggtggagctgctgggctgcgagccaggggttggactccgctgtgccagtggtgagtgtgtcctgagagggggcccttgtgacggtgttctggactgcgaggatggctcggatgaggagggctgtgtgttgctgcctgagggcactggcaggtatactgtggccggccgtgcagctcacgcccttggcctggcctttgaggggacagccatgtgggaggggcccggcactgccttcacccccaaggtgcccagaccctgcatgctgaggagctgcagccggggcctggcagagactgagcactggccccctgggcaggaatcccccacgtccccgacagaagcctgggataccctctcgagggcccccaccttcctttcctgggaaggggagctgggcaagcctcacctccctctacctacacccacagagacaaggcccgtgagtcctggcccagcctccggggtgcctcaccatggggaatctgtgcagatggtgaccaccacccccataccccagatggaggccaggaccctgccaccaggtatggcagctgtgacggtggtgcccccacaccctgtgactccagcgacccctgctggtaagatgccaagcccttctacctgtgtgcaaggcctctgccagagcgtcgccccaggacccttcccacctgtgcagtgtggccccggccagacgccctgtgaggtgctgggctgcgtggaacaggcgcaggtgtgtgatggcagggaggattgcctcgacggctccgacgagaggcactgcggtgagctgctggagggcctgctgtcctgtggggccctctgttccccgagccagctgagctgtggcagcggggagtgtctgtctgctgagcggcgctgtgacctgcggcctgactgccaggatggctcggacgaggatggctgtgtggactgcgtgctggccccctggtctgtctggagcagctgcagccgcagctgtggcctgggcctcaccttccagcgccaggagctgctgcggcctcctctgccagggggcagctgcccgcgtgaccggttccgaagccagtcctgctttgtgcaggcctgcccagtggctggggcatgggccatgtgggaggcctggggaccctgcagcgtctcctgcgggggtggccatcagagtcgccagagaagctgtgtggaccccccacccaagaatggcggtgccccctgccccggggcctcccaagagagggcaccctgcggcttgcagccctgctcaggtggcacaggtaagggggtgctgggctggggacacggagggagcactgtgggcacggggcgattgggcctcccagcacctaggctcacctggtgcccatcccccaccagactgcgagctgggccgtgtgtatgtgagtgccgatctgtgccagaaggggctggtgcccccatgcccaccctcctgcctggatcccaaggccaacagaagctgcagtgggcattgtgtggaagcctcccctccctgctgtgccccttggggctgagtgccctcttccacatactcccaggatgccgctgtcccccggggctccttctgcatgacactcgctgcctgcccctctctgagtgcccctgcctggtgggcgaagagctgaagtggccaggggtgtccttcctcctgggcaactgcagccaatgcgtgtgtgagaagggggagttgctgtgccaaccagggggctgccccctgccctgcggctggtcagcctggtcctcctgggctccctgcgaccgctcctgtggctctggagtgagggccaggttcaggtctccctccaaccctccggcagcctgggggggtgccccgtgtgaaggtgaccggcaggaactgcagggctgccacacagtgtgtgggacaggtatagccgggagcctgggtgcaggagtccccccttcctcctcccaattctgtaccctgagaacacatgggatgggacccactgaccactctacgtgggggattgaggtgttcggctggacgccctggacttcctggtcctcctgctcccaaagctgccttgccccgggagggggccctggctggcgcagtcgttcccgactctgccccagccctggggattcatcctgcccaggagatgccacccaggaggagccctgcagcccccctatagagtgtacgggcttctgcgcccccggctgcacctgcccccctggtcttttcctgcacaatgctagctgcctgccccgcagccagtgcccctgccagctgcacgggcagctctatgcatcaggagcaatggctcgcctggactcctgcaacaactgcacctgtgtctctggtaagatggcatgcacctcggagcgctgcccagtggcctgtggctggagtccctggaccctgtggagtctctgtagctgcagctgcaacgtgggcattcggcgccgcttccgggcaggcactgcacccccagctgcctttgggggtgctgagtgccaaggccccaccatggaggctgaattctgcagcctgcggccatgtccagggccagtgcctggcatgtgtcccagggacaagcagtggctggactgtgcccagggccctgcctcttgtgcagagctcagcgccccaagagggactaaccagacctgccaccctggctgccactgcccctctgggatgcttctgctggtgagcccacgtggtcaccctggaccccttggagccagtgttcagcctcctgtggccctgcccggtgccatcggcaccggttctgtgccaggagctgggggatggggtccatgggggccctggtcccactgtagccggagctgtgggggaggcctgcggagccggacccgggcctgtgaccagcccccaccccagggcctgggggattactgcgaggggccacgggcacagggggaggtctgccaggctctgccctgcccagtgaccaactgcactgccattgaaggggccgagtatagcccctgtggccctccgtgccctcgctcctgtgatgacctagtgcactgcgtgtggcgctgccagcctggctgctactgcccaccaggccaggtactgagttccaacggggccatctgcgtgcagccgggtcactgcagctgcctggacctgctgaccgggcagcggcaccatccgggtgctcggctggcaaggcctgacggctgcaaccactgcacctgcctggaggggaggctgaactgcacagacctgccctgcccagactgcgggggtggccagagtctgcatccctgtgggcagccctgcccccgctcctgccaggacctgtcccctgggagtgtgtgccagccaggctctgtgggctgccagcccacttgtgggtgccccctgggccagctctcccaggacgggctgtgcgtgcccccagcccactgccgctgccagtaccagcctggagccatggccccctcctttgtccccagcacctgtgtggcaggcattctgcaatgccaggaggtgcctgactgcccggaccctggggtgtggagctcttggggcccttgggaagactgcagtgtttcgtgtgggggcggggagcagctgcgctcccggcgctgtgctcgtcctccctgcccagggcctgcccgccagagccgcacatgcagcacacaggtctgcagagaggcaggctgcccggctggccgcctgtaccgtgaatgccagcccggcgagggatgccccttctcctgcgcccacgtcacgcagcaggtgggctgcttctctgagggctgcgaggagggctgccactgccccgagggcaccttccagcaccgcctggcctgtgtgcaggagtgcccttgtgtgctgacagcctggctgctgcaggagctgggagccaccataggtgaccctggtcagcccctcgggcctggagatgagctggactcaggccagacacttcgtacaagctgtggcaactgctcgtgtgcacacgggaagctgtcttgctccctggacgactgcttcgaggccgatggtggtttcggtccctggagcccgtggggcccgtgctcccgctcctgtggagggctgggcacccgtacccgcagccgccagtgtgtgctcaccatgcccaccctcagtgagctgcccgtgtgccctggccctggctgtggggctgggaactgttcctggacctcctgggccccgtgggaaccttgctcccgcagctgcggagtgggccagcagcgccgcctgcgggcataccgtccccctgggcccggcgggcactggtgccccaacatccttactgcctaccaagagcgccgcttctgcaacctgcgagcctgcccagaggccggctgcccagcaggcatggaggtggtcacctgtgccaaccgctgcccccgccgctgctcagacctccaggagggaattgtgtgtcaggacgaccaggtctgccagaagggctgccgctgcccaaaggggtccctggagcaggatggtggctgcgtgccaattgggcactgtgactgcaccgatgcccagggccacagctgggccccggggagccagcaccaggatgcctgcaacaactgctcatgccaagctgggcagctctcctgcacggctcagccctgcccgcctcccacccactgtgcctggagccactggtcggcctggagtccctgcagccactcatgcgggcccagagggcagcagagccgcttccgctgcggcccgggcctggcctctcgctctgggtcctgcccctgcctgatggccaaggccgaccccacctgcaacagcaccttcctccacctggacacccagggctgctactcagggccctgcccagactcatgccagtggagtctgtgggggccatggagcccctgccaggtgccctgcagtggggggttcaggctacgctggagagaggcagaggccctctgtggaggaggctgccgggagccatgggctcaagacagaaagctgcaacggagggccctgcccagcacctgtgtcaacgagtccctggtgtgcccacaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagcattctctgccctggggcctcaccctgaccctggaagagcaggcccaggagctgcccccagggactgtgctcacccggaactgcacccgctgtgtctgccacggtggagccttcagctgctccctcgttgactgtcagggtgagatagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctggtgagacaccgaaccccctctgctaccactcacccattcctgaccccaagcctccccatctgtctgtaa

SEQ ID NO: 735430 - DNA, 2385 bp, Homo sapiens
cccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccagaggctcacagttggtgtgtctctcccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtccaggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcagccctatccttccacgtgccccacccccaccatcagaccccctgttccaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctggtgagggcagcgacctttggggcaagaggaagaatgtgggggtgaagaggtagcttgggagataacgggtggggtgcagccttgttggttgcagcgtgcatgctgggggtgacagagtgctgatcacttcccctcggtcgtggggcactttagggtccataaagcactttcgtgtgcatca

SEQ ID NO: 735431 - DNA, 7651 bp, Homo sapiens
cccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccagaggctcacagttggtgtgtctctcccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtccaggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcagccctatccttccacgtgccccacccccaccatcagaccccctgttccaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctgggagcttgtctatgcccctggtgcctgtctcctcacctgtgacagccccagcgccaatcactcctgccctgcaggcagtactgatggctgtgtctgtccaccaggcacggtgctgctggacgagcgctgtgtgcctcctgacctctgtccctgccgtcacagtgggcagtggtacctgcccaacgccaccatccaggaagactgcaacgtttgcgtgtgccggggccggcagtggcactgcacaggccagcggcgcagtgggcggtgccaggcatcaggcgccccccactatgtgacatttgacggactggccttcacctatcctggggcctgcgagtatctgctggtgcgagaggccagtggcctattcacagtctctgcccagaacctgccctgtggggccagcggtctcacctgcaccaaagcgctggccgtgcgtctggagggcactgttgtgcacatgctcagagggactcgggtcctggtgcaactgtcccctcagttccgtggtcgcgtggctgggctgtgtggtgactttgatggagatgccagtaatgatctgcggagccgccagggcgtcctggagcccacagctgaactggctgcccactcctggcgcctcagccccctctgccctgagccaggagacctgccacacccctgcacgatgaacacacaccgggctggttgggctcgggcccgctgtggggcgctgctgcagccgctcttcacattatgccacgcggaggtccccccgcagcagcactatgagtggtgcctgtatgacgcctgcggctgcgactcggggggtgactgtgagtgcctctgctcggccattgccacctatgcagatgagtgtgcccggcatgggcaccacgtgcgctggcgtagccaggagctctgctgtctacaccagacaccctgtgccctccatggtggtcaccttggccagccagcctggtgtggttgcatccttttgcccttgtgcctcagtgatccaaggctctctcctctccacccagccctgcagtgtgaagggggacaggtatatgaggcctgtggccccacgtgtccccccacctgccatgagcagcatcctgagcccgggtggcactgccaggtggtggcctgtgtggagggctgcttctgccccgaggggactctgctgcacggacgctgtgtgctcagcacgtgccaggaaggtcaatggcattgtgggggtgacggtggccactgtgaggagcttgtgcctgcctgtgcagagggagaggccctgtgccaagagaatgggcactgtgtgccccatgggtggctttgtgacaaccaggacgactgtggcgatggctctgatgaggagggtgagtgtctttgcccatgcgtggaagcgacagggttggtcagtccttgcacatgttgtgccgccccaggctgtggggaggggcagatgacttgcagctccggccactgcctgcccctggccctgctctgtgaccgccaggatgactgtggagatggcacggatgagccgagctatccgtgcccccagggcttgctggcctgtgccgatggacgctgcctgccgccggccctgctctgcgatgggcatcctgactgtctggatgccgccgacgaggagtcctgtctggggcaggtgacctgcgtccccggggaggtgtcctgtgttgatggcacctgcctgggggccatccagctgtgtgacggagtctgggactgcccagatggagccgatgaggggccgggacactgccccctaccttctctgcccacacctcctgccagcaccttgcctggcccctccccaggctccctggacactgcgtcaagtcccctggccagcgccagccctgcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcgttgaggctcccgcgcccccggccatgcgcggcccccctggccaagccggcgggcccacctcttcccgagcgccatccccaccttcgcctcctgaggcacagggagagggcaggaagggacaggagcggagcaggacacatctcacagtgcccgcaggctccacccagctgcctctgtgccctggcctctttccctgtggtgtggctccggggctgtgcctgacccctgagcagctctgtgatgggatcccagactgtccccagggcgaggacgagctggactgcggggggctgccagccctgggaggccccaacaggacagggcttccctgcccagaatacacctgccccaatggcacctgcataggcttccagctggtgtgtgatgggcagcctgactgtggaaggccagggcaggtgggcccctccccagaagagcagggttgtggggcctggggcccctggagcccatgggggccctgcagccggacgtgtgggccctggggccagggccggagccgccgctgctccccactcggcctcctggtgctacagaactgcccagggcctgagcaccagtctcaggcctgcttcacggcagcctgcccagtggacggtgaatggagcacctggtccccctggtctgtgtgctctgagccgtgcaggggcaccatgacgcggcaacggcagtgccactcaccccagaatgggggccgcacctgtgctgcactgcccggaggcctgcacagcacccgccagaccaagccttgccctcaggacggctgccccaatgccacttgctctggggagctgatgttccagccctgtgccccctgcccactgacctgtgatgacatctctggccaggtcacgtgcccacctgattggccctgcggcagcccgggctgctggtgcccagaagggcaggtgctgggcagcgaggggtggtgtgtgtggccccggcagtgcccctgcctggtggacggtgcccgctactggcctgggcaacgcatcaaggccgactgccagctctgcatctgccaagacggacggccccgacgctgccgactcaacccggactgcgctggtgaggcccttccctcggggtccctagtcctctccctggaccgcccagctgcacatccaccacctccttcaggctctgactgttggccctccctcagtggactgtggctggtcctcctggtcaccctgggccaagtgcctgggcccctgtggaagccagagcatccagtggtccttccggagctccaacaacccccgcccctccggccgaggtcgccagtgccgtggcatccaccgcaaggcacgcagacggagccctgtgaggggtgtgagcatcagggccaggtccaccgtgtcggggaacgctggcatgggggcccctgcagggtgtgccagtgtctgcacaacctcaccgcacactgctcaccctactgcccgctcggcagctgcccccagggctgggtcttggtggaggggacgggagaatcatgctgccactgtgccctacctggagagaaccagacggtccagcccatggccactcctgccgcagctccggctcccagtccccagatcagattccctttggccacttacattctgcctccgtcaggaggctcctgccgccctctgtcctcccctactccagcctgtctctctcttctgcacccagacccctgctattctcccctggggctggccggactggctgaggggagtctgcatgcatcgtcccagcagctggaacaccccacccaggctgccctcctgggggctcccacccaggggcccagccctcagggatggcacgctggaggggatgcttatgccaagtggcacactcggccccattacctgcagctggacctgcttcagcctcggaacctcactggcatcctagtgccggagactggctcctccaacgcatatgccagcagcttctcactccagttcagcagcaatggtctacactggcatgactatcgtgacctcctgcctggcatcttgcccctgcccaaggtatcacccgcccaaggccgatggggccagcagcccaccatgcccttttgtgggttccatagtctttgtccccaagggccttccagtgtccccgaggggcatggcctgcattcgatgcttgttgaatacctgcttttccccagaaactgggatgacctggaccctgccgtatggactttcggccgcatggtgcaggcgaggtttgtcagggtgtggccccacgatgtccaccacagcgatgtccccctgcaggtggagctgctgggctgcgagccaggggttggactccgctgtgccagtggtgagtgtgtcctgagagggggcccttgtgacggtgttctggactgcgaggatggctcggatgaggagggctgtgtgttgctgcctgagggcactggcaggtatactgtggccggccgtgcagctcacgcccttggcctggcctttgaggggacagccatgtgggaggggcccggcactgccttcacccccaaggtgcccagaccctgcatgctgaggagctgcagccggggcctggcagagactgagcactggccccctgggcaggaatcccccacgtccccgacagaagcctgggataccctctcgagggcccccaccttcctttcctgggaaggggagctgggcaagcctcacctccctctacctacacccacagagacaaggcccgtgagtcctggcccagcctccggggtgcctcaccatggggaatctgtgcagatggtgaccaccacccccataccccagatggaggccaggaccctgccaccaggtatggcagctgtgacggtggtgcccccacaccctgtgactccagcgacccctgctggtaagatgccaagcccttctacctgtgtgcaaggcctctgccagagcgtcgccccaggacccttcccacctgtgcagtgtggccccggccagacgccctgtgaggtgctgggctgcgtggaacaggcgcaggtgtgtgatggcagggaggattgcctcgacggctccgacgagaggcactgcggtgagctgctggagggcctgctgtcctgtgggtagggggtggcacttatccttcagtgtaggaaagtgtctgccctcatttgtagctcatattggaaaggatctgggggaggcttgggcagcagggaatggagaaaatgggtaaaaacaggagtgtgtgtgtctttgggggtggtcaagaccgggaataggataggccttgggtctcagcctattttataaaacctgtttgacctttgaagagactcatctactcactcaccca

SEQ ID NO: 735432 - DNA, 11813 bp, Homo sapiens
cccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccagaggctcacagttggtgtgtctctcccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtccaggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcagccctatccttccacgtgccccacccccaccatcagaccccctgttccaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctgggagcttgtctatgcccctggtgcctgtctcctcacctgtgacagccccagcgccaatcactcctgccctgcaggcagtactgatggctgtgtctgtccaccaggcacggtgctgctggacgagcgctgtgtgcctcctgacctctgtccctgccgtcacagtgggcagtggtacctgcccaacgccaccatccaggaagactgcaacgtttgcgtgtgccggggccggcagtggcactgcacaggccagcggcgcagtgggcggtgccaggcatcaggcgccccccactatgtgacatttgacggactggccttcacctatcctggggcctgcgagtatctgctggtgcgagaggccagtggcctattcacagtctctgcccagaacctgccctgtggggccagcggtctcacctgcaccaaagcgctggccgtgcgtctggagggcactgttgtgcacatgctcagagggactcgggtcctggtgcaactgtcccctcagttccgtggtcgcgtggctgggctgtgtggtgactttgatggagatgccagtaatgatctgcggagccgccagggcgtcctggagcccacagctgaactggctgcccactcctggcgcctcagccccctctgccctgagccaggagacctgccacacccctgcacgatgaacacacaccgggctggttgggctcgggcccgctgtggggcgctgctgcagccgctcttcacattatgccacgcggaggtccccccgcagcagcactatgagtggtgcctgtatgacgcctgcggctgcgactcggggggtgactgtgagtgcctctgctcggccattgccacctatgcagatgagtgtgcccggcatgggcaccacgtgcgctggcgtagccaggagctctgctgtctacaccagacaccctgtgccctccatggtggtcaccttggccagccagcctggtgtggttgcatccttttgcccttgtgcctcagtgatccaaggctctctcctctccacccagccctgcagtgtgaagggggacaggtatatgaggcctgtggccccacgtgtccccccacctgccatgagcagcatcctgagcccgggtggcactgccaggtggtggcctgtgtggagggctgcttctgccccgaggggactctgctgcacggacgctgtgtgctcagcacgtgccaggaaggtcaatggcattgtgggggtgacggtggccactgtgaggagcttgtgcctgcctgtgcagagggagaggccctgtgccaagagaatgggcactgtgtgccccatgggtggctttgtgacaaccaggacgactgtggcgatggctctgatgaggagggtgagtgtctttgcccatgcgtggaagcgacagggttggtcagtccttgcacatgttgtgccgccccaggctgtggggaggggcagatgacttgcagctccggccactgcctgcccctggccctgctctgtgaccgccaggatgactgtggagatggcacggatgagccgagctatccgtgcccccagggcttgctggcctgtgccgatggacgctgcctgccgccggccctgctctgcgatgggcatcctgactgtctggatgccgccgacgaggagtcctgtctggggcaggtgacctgcgtccccggggaggtgtcctgtgttgatggcacctgcctgggggccatccagctgtgtgacggagtctgggactgcccagatggagccgatgaggggccgggacactgccccctaccttctctgcccacacctcctgccagcaccttgcctggcccctccccaggctccctggacactgcgtcaagtcccctggccagcgccagccctgcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcgttgaggctcccgcgcccccggccatgcgcggcccccctggccaagccggcgggcccacctcttcccgagcgccatccccaccttcgcctcctgaggcacagggagagggcaggaagggacaggagcggagcaggacacatctcacagtgcccgcaggctccacccagctgcctctgtgccctggcctctttccctgtggtgtggctccggggctgtgcctgacccctgagcagctctgtgatgggatcccagactgtccccagggcgaggacgagctggactgcggggggctgccagccctgggaggccccaacaggacagggcttccctgcccagaatacacctgccccaatggcacctgcataggcttccagctggtgtgtgatgggcagcctgactgtggaaggccagggcaggtgggcccctccccagaagagcagggttgtggggcctggggcccctggagcccatgggggccctgcagccggacgtgtgggccctggggccagggccggagccgccgctgctccccactcggcctcctggtgctacagaactgcccagggcctgagcaccagtctcaggcctgcttcacggcagcctgcccagtggacggtgaatggagcacctggtccccctggtctgtgtgctctgagccgtgcaggggcaccatgacgcggcaacggcagtgccactcaccccagaatgggggccgcacctgtgctgcactgcccggaggcctgcacagcacccgccagaccaagccttgccctcaggacggctgccccaatgccacttgctctggggagctgatgttccagccctgtgccccctgcccactgacctgtgatgacatctctggccaggtcacgtgcccacctgattggccctgcggcagcccgggctgctggtgcccagaagggcaggtgctgggcagcgaggggtggtgtgtgtggccccggcagtgcccctgcctggtggacggtgcccgctactggcctgggcaacgcatcaaggccgactgccagctctgcatctgccaagacggacggccccgacgctgccgactcaacccggactgcgctggtgaggcccttccctcggggtccctagtcctctccctggaccgcccagctgcacatccaccacctccttcaggctctgactgttggccctccctcagtggactgtggctggtcctcctggtcaccctgggccaagtgcctgggcccctgtggaagccagagcatccagtggtccttccggagctccaacaacccccgcccctccggccgaggtcgccagtgccgtggcatccaccgcaaggcacgcagacggagccctgtgaggggtgtgagcatcagggccaggtccaccgtgtcggggaacgctggcatgggggcccctgcagggtgtgccagtgtctgcacaacctcaccgcacactgctcaccctactgcccgctcggcagctgcccccagggctgggtcttggtggaggggacgggagaatcatgctgccactgtgccctacctggagagaaccagacggtccagcccatggccactcctgccgcagctccggctcccagtccccagatcagattccctttggccacttacattctgcctccgtcaggaggctcctgccgccctctgtcctcccctactccagcctgtctctctcttctgcacccagacccctgctattctcccctggggctggccggactggctgaggggagtctgcatgcatcgtcccagcagctggaacaccccacccaggctgccctcctgggggctcccacccaggggcccagccctcagggatggcacgctggaggggatgcttatgccaagtggcacactcggccccattacctgcagctggacctgcttcagcctcggaacctcactggcatcctagtgccggagactggctcctccaacgcatatgccagcagcttctcactccagttcagcagcaatggtctacactggcatgactatcgtgacctcctgcctggcatcttgcccctgcccaaggtatcacccgcccaaggccgatggggccagcagcccaccatgcccttttgtgggttccatagtctttgtccccaagggccttccagtgtccccgaggggcatggcctgcattcgatgcttgttgaatacctgcttttccccagaaactgggatgacctggaccctgccgtatggactttcggccgcatggtgcaggcgaggtttgtcagggtgtggccccacgatgtccaccacagcgatgtccccctgcaggtggagctgctgggctgcgagccaggggttggactccgctgtgccagtggtgagtgtgtcctgagagggggcccttgtgacggtgttctggactgcgaggatggctcggatgaggagggctgtgtgttgctgcctgagggcactggcaggtatactgtggccggccgtgcagctcacgcccttggcctggcctttgaggggacagccatgtgggaggggcccggcactgccttcacccccaaggtgcccagaccctgcatgctgaggagctgcagccggggcctggcagagactgagcactggccccctgggcaggaatcccccacgtccccgacagaagcctgggataccctctcgagggcccccaccttcctttcctgggaaggggagctgggcaagcctcacctccctctacctacacccacagagacaaggcccgtgagtcctggcccagcctccggggtgcctcaccatggggaatctgtgcagatggtgaccaccacccccataccccagatggaggccaggaccctgccaccaggtatggcagctgtgacggtggtgcccccacaccctgtgactccagcgacccctgctggtaagatgccaagcccttctacctgtgtgcaaggcctctgccagagcgtcgccccaggacccttcccacctgtgcagtgtggccccggccagacgccctgtgaggtgctgggctgcgtggaacaggcgcaggtgtgtgatggcagggaggattgcctcgacggctccgacgagaggcactgcggtgagctgctggagggcctgctgtcctgtggggccctctgttccccgagccagctgagctgtggcagcggggagtgtctgtctgctgagcggcgctgtgacctgcggcctgactgccaggatggctcggacgaggatggctgtgtggactgcgtgctggccccctggtctgtctggagcagctgcagccgcagctgtggcctgggcctcaccttccagcgccaggagctgctgcggcctcctctgccagggggcagctgcccgcgtgaccggttccgaagccagtcctgctttgtgcaggcctgcccagtggctggggcatgggccatgtgggaggcctggggaccctgcagcgtctcctgcgggggtggccatcagagtcgccagagaagctgtgtggaccccccacccaagaatggcggtgccccctgccccggggcctcccaagagagggcaccctgcggcttgcagccctgctcaggtggcacaggtaagggggtgctgggctggggacacggagggagcactgtgggcacggggcgattgggcctcccagcacctaggctcacctggtgcccatcccccaccagactgcgagctgggccgtgtgtatgtgagtgccgatctgtgccagaaggggctggtgcccccatgcccaccctcctgcctggatcccaaggccaacagaagctgcagtgggcattgtgtggaagcctcccctccctgctgtgccccttggggctgagtgccctcttccacatactcccaggatgccgctgtcccccggggctccttctgcatgacactcgctgcctgcccctctctgagtgcccctgcctggtgggcgaagagctgaagtggccaggggtgtccttcctcctgggcaactgcagccaatgcgtgtgtgagaagggggagttgctgtgccaaccagggggctgccccctgccctgcggctggtcagcctggtcctcctgggctccctgcgaccgctcctgtggctctggagtgagggccaggttcaggtctccctccaaccctccggcagcctgggggggtgccccgtgtgaaggtgaccggcaggaactgcagggctgccacacagtgtgtgggacaggtatagccgggagcctgggtgcaggagtccccccttcctcctcccaattctgtaccctgagaacacatgggatgggacccactgaccactctacgtgggggattgaggtgttcggctggacgccctggacttcctggtcctcctgctcccaaagctgccttgccccgggagggggccctggctggcgcagtcgttcccgactctgccccagccctggggattcatcctgcccaggagatgccacccaggaggagccctgcagcccccctatagagtgtacgggcttctgcgcccccggctgcacctgcccccctggtcttttcctgcacaatgctagctgcctgccccgcagccagtgcccctgccagctgcacgggcagctctatgcatcaggagcaatggctcgcctggactcctgcaacaactgcacctgtgtctctggtaagatggcatgcacctcggagcgctgcccagtggcctgtggctggagtccctggaccctgtggagtctctgtagctgcagctgcaacgtgggcattcggcgccgcttccgggcaggcactgcacccccagctgcctttgggggtgctgagtgccaaggccccaccatggaggctgaattctgcagcctgcggccatgtccagggccagtgcctggcatgtgtcccagggacaagcagtggctggactgtgcccagggccctgcctcttgtgcagagctcagcgccccaagagggactaaccagacctgccaccctggctgccactgcccctctgggatgcttctgctggtgagcccacgtggtcaccctggaccccttggagccagtgttcagcctcctgtggccctgcccggtgccatcggcaccggttctgtgccaggagctgggggatggggtccatgggggccctggtcccactgtagccggagctgtgggggaggcctgcggagccggacccgggcctgtgaccagcccccaccccagggcctgggggattactgcgaggggccacgggcacagggggaggtctgccaggctctgccctgcccagtgaccaactgcactgccattgaaggggccgagtatagcccctgtggccctccgtgccctcgctcctgtgatgacctagtgcactgcgtgtggcgctgccagcctggctgctactgcccaccaggccaggtactgagttccaacggggccatctgcgtgcagccgggtcactgcagctgcctggacctgctgaccgggcagcggcaccatccgggtgctcggctggcaaggcctgacggctgcaaccactgcacctgcctggaggggaggctgaactgcacagacctgccctgcccagactgcgggggtggccagagtctgcatccctgtgggcagccctgcccccgctcctgccaggacctgtcccctgggagtgtgtgccagccaggctctgtgggctgccagcccacttgtgggtgccccctgggccagctctcccaggacgggctgtgcgtgcccccagcccactgccgctgccagtaccagcctggagccatggccccctcctttgtccccagcacctgtgtggcaggcattctgcaatgccaggaggtgcctgactgcccggaccctggggtgtggagctcttggggcccttgggaagactgcagtgtttcgtgtgggggcggggagcagctgcgctcccggcgctgtgctcgtcctccctgcccagggcctgcccgccagagccgcacatgcagcacacaggtctgcagagaggcaggctgcccggctggccgcctgtaccgtgaatgccagcccggcgagggatgccccttctcctgcgcccacgtcacgcagcaggtgggctgcttctctgagggctgcgaggagggctgccactgccccgagggcaccttccagcaccgcctggcctgtgtgcaggagtgcccttgtgtgctgacagcctggctgctgcaggagctgggagccaccataggtgaccctggtcagcccctcgggcctggagatgagctggactcaggccagacacttcgtacaagctgtggcaactgctcgtgtgcacacgggaagctgtcttgctccctggacgactgcttcgaggccgatggtggtttcggtccctggagcccgtggggcccgtgctcccgctcctgtggagggctgggcacccgtacccgcagccgccagtgtgtgctcaccatgcccaccctcagtgagctgcccgtgtgccctggccctggctgtggggctgggaactgttcctggacctcctgggccccgtgggaaccttgctcccgcagctgcggagtgggccagcagcgccgcctgcgggcataccgtccccctgggcccggcgggcactggtgccccaacatccttactgcctaccaagagcgccgcttctgcaacctgcgagcctgcccagaggccggctgcccagcaggcatggaggtggtcacctgtgccaaccgctgcccccgccgctgctcagacctccaggagggaattgtgtgtcaggacgaccaggtctgccagaagggctgccgctgcccaaaggggtccctggagcaggatggtggctgcgtgccaattgggcactgtgactgcaccgatgcccagggccacagctgggccccggggagccagcaccaggatgcctgcaacaactgctcatgccaagctgggcagctctcctgcacggctcagccctgcccgcctcccacccactgtgcctggagccactggtcggcctggagtccctgcagccactcatgcgggcccagagggcagcagagccgcttccgctgcggcccgggcctggcctctcgctctgggtcctgcccctgcctgatggccaaggccgaccccacctgcaacagcaccttcctccacctggacacccagggctgctactcagggccctgcccagaggacagctgcacgcctccctttgagttccatgcctgcggctccccctgtgctgggctctgtgccacacacctgagccatcagctctgccaggacctgccaccctgccagccgggctgctactgccccaaggggctgctggagcaggctgggggctgcattcccccagaggagtgtaactgctggcatacctcagcagcaggagccgggatgaccctggcccctggggaccgcctgcagctgggctgtaaggagtgtgaatgccggcgtggggagctgcactgcaccagccagggctgtcaaggtcttctgcctctgagtgagtggtccgagtggtcgccctgtgggccctgcctgccgcccag

SEQ ID NO: 735433 - DNA, 12477 bp, Homo sapiens
cccttgccaaagccagtcctgaaggccactgctttgccatgtggcagtgccagctacaggcaggctcagctaatgcctcagcaggaagcctggaggagtgctgcgcccggccctggggacaaagctggtgggatggcagctcccaggcctgccgcagctgctccagccgacacctgccagaggctcacagttggtgtgtctctcccaggcagtgcctcttctccagccctcctgcagcccctggcaggggctgtgggccagctctggagccagcaccagcgtccctcggccacctgtgcctcctggtcgggcttccactaccgcacctttgatggccgccactatcacttcctgggccgctgcacctacctgctggcgggtgctgcggactccacctgggctgtccacctaacacccggggaccgctgcccccagcctggacactgtcagcgggtccaggtgactatgggacccgaggaggtgctgatccaggctggaaatgtgtctgtgaaggggcagctggtacctgaagggcagtcttggctgctccacgggctgagcctgcaatggctgggggactggctggtgctgtcaggaggcctgggggtcgtggtgcggctggacaggactggctccatctccatctctgtggaccacgagctctggggacagacacaaggcctctgtgggctctacaatggctggccagaggatgacttcatggagccaggcggagggctggccatgttagcagccacctttggaaattcctggaggctccctggctcggaggtttcccctgctgagtaccacgaggcctgtctctttgcctactgcgcaggggccatggcaggcagtgggcaagaggggcggcagcaggctgtttgtgccacctttgccagctatgtccaggcctgtgccaggcggcacatccacattcgctggaggaagcctggcttctgcgagcgcctgtgccccgggggccagctctactccgactgcgtctccctctgcccacccagctgcgaggcggtgggtcagggagaggaggagtcctgcagggaagagtgtgtgagtggctgtgagtgcccgcgaggcctcttctggaatggcaccctctgtgtgcctgctgcccactgcccctgctactactgccgccagcgctatgtacccggtgacaccgtgcgccagctgtgtaacccctgcgtgtgcagggatggccgctggcactgtgcccaggcactgtgccccgccgagtgtgcagtgggtggggacgggcactacctcaccttcgatgggcggagctactccttctggggtggtcaaggttgccgctacagcctggtgcagccctatccttccacgtgccccacccccaccatcagaccccctgttccaggagctgtgctggtcaatgggcaggatgtgggcttgccctggattggcgctgagggcctcagtgtgcgccgagcttcctctgcctttctgctgctgcgctggcctggggcccaggtgctctggggactgtctgaccctgtagcctacatcaccctggacccccgccatgcccaccaggtgcagggtctgtgtggcaccttcacccagaaccagcaggacgacttcctgacaccagccggagatgtggaaactagcattgctgcctttgctagcaagttccaggtggccggcaagggaagatgcccctctgaggacagtgccctgctgtctccctgcaccacccactcccagcgccacgccttcgcagaggcggcctgtgccatcctgcacagctctgtcttccaggaatgccacaggctggtggacaaagagccattctatctgcgctgcctggcagccgtgtgtggctgtgatcccggcagtgactgcctgtgcccggtgctgtctgcctatgcgcgtcgctgtgcccaggaaggtgcctcacctccctggaggaaccagaccctctgccctgttatgtgtcctggtggccaggagtaccgagagtgtgccccagcatgcggtcaacactgcgggaaaccagaggactgtggagagctgggcagctgtgtggctggttgtaactgtcctctggggctgctgtgggaccctgagggccagtgtgtgccccccagcttgtgcccctgccagctcggagcccgtcgctatgcccctggcagtgccaccatgaaggagtgcaaccgctgggagcttgtctatgcccctggtgcctgtctcctcacctgtgacagccccagcgccaatcactcctgccctgcaggcagtactgatggctgtgtctgtccaccaggcacggtgctgctggacgagcgctgtgtgcctcctgacctctgtccctgccgtcacagtgggcagtggtacctgcccaacgccaccatccaggaagactgcaacgtttgcgtgtgccggggccggcagtggcactgcacaggccagcggcgcagtgggcggtgccaggcatcaggcgccccccactatgtgacatttgacggactggccttcacctatcctggggcctgcgagtatctgctggtgcgagaggccagtggcctattcacagtctctgcccagaacctgccctgtggggccagcggtctcacctgcaccaaagcgctggccgtgcgtctggagggcactgttgtgcacatgctcagagggactcgggtcctggtgcaactgtcccctcagttccgtggtcgcgtggctgggctgtgtggtgactttgatggagatgccagtaatgatctgcggagccgccagggcgtcctggagcccacagctgaactggctgcccactcctggcgcctcagccccctctgccctgagccaggagacctgccacacccctgcacgatgaacacacaccgggctggttgggctcgggcccgctgtggggcgctgctgcagccgctcttcacattatgccacgcggaggtccccccgcagcagcactatgagtggtgcctgtatgacgcctgcggctgcgactcggggggtgactgtgagtgcctctgctcggccattgccacctatgcagatgagtgtgcccggcatgggcaccacgtgcgctggcgtagccaggagctctgctgtctacaccagacaccctgtgccctccatggtggtcaccttggccagccagcctggtgtggttgcatccttttgcccttgtgcctcagtgatccaaggctctctcctctccacccagccctgcagtgtgaagggggacaggtatatgaggcctgtggccccacgtgtccccccacctgccatgagcagcatcctgagcccgggtggcactgccaggtggtggcctgtgtggagggctgcttctgccccgaggggactctgctgcacggacgctgtgtgctcagcacgtgccaggaaggtcaatggcattgtgggggtgacggtggccactgtgaggagcttgtgcctgcctgtgcagagggagaggccctgtgccaagagaatgggcactgtgtgccccatgggtggctttgtgacaaccaggacgactgtggcgatggctctgatgaggagggtgagtgtctttgcccatgcgtggaagcgacagggttggtcagtccttgcacatgttgtgccgccccaggctgtggggaggggcagatgacttgcagctccggccactgcctgcccctggccctgctctgtgaccgccaggatgactgtggagatggcacggatgagccgagctatccgtgcccccagggcttgctggcctgtgccgatggacgctgcctgccgccggccctgctctgcgatgggcatcctgactgtctggatgccgccgacgaggagtcctgtctggggcaggtgacctgcgtccccggggaggtgtcctgtgttgatggcacctgcctgggggccatccagctgtgtgacggagtctgggactgcccagatggagccgatgaggggccgggacactgccccctaccttctctgcccacacctcctgccagcaccttgcctggcccctccccaggctccctggacactgcgtcaagtcccctggccagcgccagccctgcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggacgagggccccgacgcctgcgttgaggctcccgcgcccccggccatgcgcggcccccctggccaagccggcgggcccacctcttcccgagcgccatccccaccttcgcctcctgaggcacagggagagggcaggaagggacaggagcggagcaggacacatctcacagtgcccgcaggctccacccagctgcctctgtgccctggcctctttccctgtggtgtggctccggggctgtgcctgacccctgagcagctctgtgatgggatcccagactgtccccagggcgaggacgagctggactgcggggggctgccagccctgggaggccccaacaggacagggcttccctgcccagaatacacctgccccaatggcacctgcataggcttccagctggtgtgtgatgggcagcctgactgtggaaggccagggcaggtgggcccctccccagaagagcagggttgtggggcctggggcccctggagcccatgggggccctgcagccggacgtgtgggccctggggccagggccggagccgccgctgctccccactcggcctcctggtgctacagaactgcccagggcctgagcaccagtctcaggcctgcttcacggcagcctgcccagtggacggtgaatggagcacctggtccccctggtctgtgtgctctgagccgtgcaggggcaccatgacgcggcaacggcagtgccactcaccccagaatgggggccgcacctgtgctgcactgcccggaggcctgcacagcacccgccagaccaagccttgccctcaggacggctgccccaatgccacttgctctggggagctgatgttccagccctgtgccccctgcccactgacctgtgatgacatctctggccaggtcacgtgcccacctgattggccctgcggcagcccgggctgctggtgcccagaagggcaggtgctgggcagcgaggggtggtgtgtgtggccccggcagtgcccctgcctggtggacggtgcccgctactggcctgggcaacgcatcaaggccgactgccagctctgcatctgccaagacggacggccccgacgctgccgactcaacccggactgcgctggtgaggcccttccctcggggtccctagtcctctccctggaccgcccagctgcacatccaccacctccttcaggctctgactgttggccctccctcagtggactgtggctggtcctcctggtcaccctgggccaagtgcctgggcccctgtggaagccagagcatccagtggtccttccggagctccaacaacccccgcccctccggccgaggtcgccagtgccgtggcatccaccgcaaggcacgcagacggagccctgtgaggggtgtgagcatcagggccaggtccaccgtgtcggggaacgctggcatgggggcccctgcagggtgtgccagtgtctgcacaacctcaccgcacactgctcaccctactgcccgctcggcagctgcccccagggctgggtcttggtggaggggacgggagaatcatgctgccactgtgccctacctggagagaaccagacggtccagcccatggccactcctgccgcagctccggctcccagtccccagatcagattccctttggccacttacattctgcctccgtcaggaggctcctgccgccctctgtcctcccctactccagcctgtctctctcttctgcacccagacccctgctattctcccctggggctggccggactggctgaggggagtctgcatgcatcgtcccagcagctggaacaccccacccaggctgccctcctgggggctcccacccaggggcccagccctcagggatggcacgctggaggggatgcttatgccaagtggcacactcggccccattacctgcagctggacctgcttcagcctcggaacctcactggcatcctagtgccggagactggctcctccaacgcatatgccagcagcttctcactccagttcagcagcaatggtctacactggcatgactatcgtgacctcctgcctggcatcttgcccctgcccaaggtatcacccgcccaaggccgatggggccagcagcccaccatgcccttttgtgggttccatagtctttgtccccaagggccttccagtgtccccgaggggcatggcctgcattcgatgcttgttgaatacctgcttttccccagaaactgggatgacctggaccctgccgtatggactttcggccgcatggtgcaggcgaggtttgtcagggtgtggccccacgatgtccaccacagcgatgtccccctgcaggtggagctgctgggctgcgagccaggggttggactccgctgtgccagtggtgagtgtgtcctgagagggggcccttgtgacggtgttctggactgcgaggatggctcggatgaggagggctgtgtgttgctgcctgagggcactggcaggtatactgtggccggccgtgcagctcacgcccttggcctggcctttgaggggacagccatgtgggaggggcccggcactgccttcacccccaaggtgcccagaccctgcatgctgaggagctgcagccggggcctggcagagactgagcactggccccctgggcaggaatcccccacgtccccgacagaagcctgggataccctctcgagggcccccaccttcctttcctgggaaggggagctgggcaagcctcacctccctctacctacacccacagagacaaggcccgtgagtcctggcccagcctccggggtgcctcaccatggggaatctgtgcagatggtgaccaccacccccataccccagatggaggccaggaccctgccaccaggtatggcagctgtgacggtggtgcccccacaccctgtgactccagcgacccctgctggtaagatgccaagcccttctacctgtgtgcaaggcctctgccagagcgtcgccccaggacccttcccacctgtgcagtgtggccccggccagacgccctgtgaggtgctgggctgcgtggaacaggcgcaggtgtgtgatggcagggaggattgcctcgacggctccgacgagaggcactgcggtgagctgctggagggcctgctgtcctgtggggccctctgttccccgagccagctgagctgtggcagcggggagtgtctgtctgctgagcggcgctgtgacctgcggcctgactgccaggatggctcggacgaggatggctgtgtggactgcgtgctggccccctggtctgtctggagcagctgcagccgcagctgtggcctgggcctcaccttccagcgccaggagctgctgcggcctcctctgccagggggcagctgcccgcgtgaccggttccgaagccagtcctgctttgtgcaggcctgcccagtggctggggcatgggccatgtgggaggcctggggaccctgcagcgtctcctgcgggggtggccatcagagtcgccagagaagctgtgtggaccccccacccaagaatggcggtgccccctgccccggggcctcccaagagagggcaccctgcggcttgcagccctgctcaggtggcacaggtaagggggtgctgggctggggacacggagggagcactgtgggcacggggcgattgggcctcccagcacctaggctcacctggtgcccatcccccaccagactgcgagctgggccgtgtgtatgtgagtgccgatctgtgccagaaggggctggtgcccccatgcccaccctcctgcctggatcccaaggccaacagaagctgcagtgggcattgtgtggaagcctcccctccctgctgtgccccttggggctgagtgccctcttccacatactcccaggatgccgctgtcccccggggctccttctgcatgacactcgctgcctgcccctctctgagtgcccctgcctggtgggcgaagagctgaagtggccaggggtgtccttcctcctgggcaactgcagccaatgcgtgtgtgagaagggggagttgctgtgccaaccagggggctgccccctgccctgcggctggtcagcctggtcctcctgggctccctgcgaccgctcctgtggctctggagtgagggccaggttcaggtctccctccaaccctccggcagcctgggggggtgccccgtgtgaaggtgaccggcaggaactgcagggctgccacacagtgtgtgggacaggtatagccgggagcctgggtgcaggagtccccccttcctcctcccaattctgtaccctgagaacacatgggatgggacccactgaccactctacgtgggggattgaggtgttcggctggacgccctggacttcctggtcctcctgctcccaaagctgccttgccccgggagggggccctggctggcgcagtcgttcccgactctgccccagccctggggattcatcctgcccaggagatgccacccaggaggagccctgcagcccccctatagagtgtacgggcttctgcgcccccggctgcacctgcccccctggtcttttcctgcacaatgctagctgcctgccccgcagccagtgcccctgccagctgcacgggcagctctatgcatcaggagcaatggctcgcctggactcctgcaacaactgcacctgtgtctctggtaagatggcatgcacctcggagcgctgcccagtggcctgtggctggagtccctggaccctgtggagtctctgtagctgcagctgcaacgtgggcattcggcgccgcttccgggcaggcactgcacccccagctgcctttgggggtgctgagtgccaaggccccaccatggaggctgaattctgcagcctgcggccatgtccagggccagtgcctggcatgtgtcccagggacaagcagtggctggactgtgcccagggccctgcctcttgtgcagagctcagcgccccaagagggactaaccagacctgccaccctggctgccactgcccctctgggatgcttctgctggtgagcccacgtggtcaccctggaccccttggagccagtgttcagcctcctgtggccctgcccggtgccatcggcaccggttctgtgccaggagctgggggatggggtccatgggggccctggtcccactgtagccggagctgtgggggaggcctgcggagccggacccgggcctgtgaccagcccccaccccagggcctgggggattactgcgaggggccacgggcacagggggaggtctgccaggctctgccctgcccagtgaccaactgcactgccattgaaggggccgagtatagcccctgtggccctccgtgccctcgctcctgtgatgacctagtgcactgcgtgtggcgctgccagcctggctgctactgcccaccaggccaggtactgagttccaacggggccatctgcgtgcagccgggtcactgcagctgcctggacctgctgaccgggcagcggcaccatccgggtgctcggctggcaaggcctgacggctgcaaccactgcacctgcctggaggggaggctgaactgcacagacctgccctgcccagactgcgggggtggccagagtctgcatccctgtgggcagccctgcccccgctcctgccaggacctgtcccctgggagtgtgtgccagccaggctctgtgggctgccagcccacttgtgggtgccccctgggccagctctcccaggacgggctgtgcgtgcccccagcccactgccgctgccagtaccagcctggagccatggccccctcctttgtccccagcacctgtgtggcaggcattctgcaatgccaggaggtgcctgactgcccggaccctggggtgtggagctcttggggcccttgggaagactgcagtgtttcgtgtgggggcggggagcagctgcgctcccggcgctgtgctcgtcctccctgcccagggcctgcccgccagagccgcacatgcagcacacaggtctgcagagaggcaggctgcccggctggccgcctgtaccgtgaatgccagcccggcgagggatgccccttctcctgcgcccacgtcacgcagcaggtgggctgcttctctgagggctgcgaggagggctgccactgccccgagggcaccttccagcaccgcctggcctgtgtgcaggagtgcccttgtgtgctgacagcctggctgctgcaggagctgggagccaccataggtgaccctggtcagcccctcgggcctggagatgagctggactcaggccagacacttcgtacaagctgtggcaactgctcgtgtgcacacgggaagctgtcttgctccctggacgactgcttcgaggccgatggtggtttcggtccctggagcccgtggggcccgtgctcccgctcctgtggagggctgggcacccgtacccgcagccgccagtgtgtgctcaccatgcccaccctcagtgagctgcccgtgtgccctggccctggctgtggggctgggaactgttcctggacctcctgggccccgtgggaaccttgctcccgcagctgcggagtgggccagcagcgccgcctgcgggcataccgtccccctgggcccggcgggcactggtgccccaacatccttactgcctaccaagagcgccgcttctgcaacctgcgagcctgcccagaggccggctgcccagcaggcatggaggtggtcacctgtgccaaccgctgcccccgccgctgctcagacctccaggagggaattgtgtgtcaggacgaccaggtctgccagaagggctgccgctgcccaaaggggtccctggagcaggatggtggctgcgtgccaattgggcactgtgactgcaccgatgcccagggccacagctgggccccggggagccagcaccaggatgcctgcaacaactgctcatgccaagctgggcagctctcctgcacggctcagccctgcccgcctcccacccactgtgcctggagccactggtcggcctggagtccctgcagccactcatgcgggcccagagggcagcagagccgcttccgctgcggcccgggcctggcctctcgctctgggtcctgcccctgcctgatggccaaggccgaccccacctgcaacagcaccttcctccacctggacacccagggctgctactcagggccctgcccagactcatgccagtggagtctgtgggggccatggagcccctgccaggtgccctgcagtggggggttcaggctacgctggagagaggcagaggccctctgtggaggaggctgccgggagccatgggctcaagacagaaagctgcaacggagggccctgcccagcacctgtgtcaacgagtccctggtgtgcccacaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagcattctctgccctggggcctcaccctgaccctggaagagcaggcccaggagctgcccccagggactgtgctcacccggaactgcacccgctgtgtctgccacggtggagccttcagctgctccctcgttgactgtcagggtgagatagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctgcctggatctgaatggcaggaggcctgtgagagctgcctctgcctcagtgggaggcctgtctgcacccagcactgctccccactcacctgtgctcagggcgaggagatggtgctggagccagggagctgctgtccctcttgccgcagggaggctccgggtatggagggaacctgg

SEQ ID NO: 735434 - DNA, 830 bp, Homo sapiens
  misc_feature (70)..(70): n is a, c, g, or t
  misc_feature (77)..(77): n is a, c, g, or t
  misc_feature (79)..(79): n is a, c, g, or t
gcctcatgtgatcctctgtgagttcatgtgactcttctgtgtcatctgtgtcaaaatactgagttgcttntgtaagncnttaaagattgttaccctagtgtttcatttcctagaccagtattttgaacaatattatattttggagactgatgggagaagactggcatcttctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagaaaaaaggccaggcatcccaacactttggaaggctgaggcggacagatcatgaggtcaggatattgagaccatcctggctaacaggtgaaacccggtctctactaaaaatacgaaaaattagctgggcatggtggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaaaaagtgtagaaaaacttgactttaacttcaaagtttaatttgaaagtttaaacaggccaggcgcggtggctcacacctgtaatcccagcactttgggaggctgaggcaggtggatcacaaggtcaggagatcgagaccatcctggctaacatggtgaaaccccgactctactaaaaataca

SEQ ID NO: 735435 - DNA, 430 bp, Homo sapiens
cagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaaacctcgtgccgaattcggcacgaggagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctccc

SEQ ID NO: 735436 - DNA, 2271 bp, Homo sapiens
atggctggtactgagactcccagcactaaccttcctgggttgtgtctgtctctgtggtcccaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccaggtg

SEQ ID NO: 735437 - DNA, 1574 bp, Homo sapiens
atggctggtactgagactcccagcactaaccttcctgggttgtgtctgtctctgtggtcccaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcaggtaaggtgcctcatgcacagatcctattatttatttttttcctttgttttgttttgtttttcttgagatagggtctctccccgctggccaggctgaagtgcagtggtgcaatctcagttcactgcagcctcgatatcctgggctctagccattctccccccctcactctcctgagtacctgggactacaagtgagcaccaccacacccagctaatttttatttattttttattttttttgagacggagtctcgctctgtcacccaggctggaatgcagtggcgcaatctcggctcactgtaacctccaactcccaggttcaagcgattc

SEQ ID NO: 735438 - DNA, 1360 bp, Homo sapiens
ggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcg

SEQ ID NO: 735439 - DNA, 1211 bp, Homo sapiens
agctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagcc

SEQ ID NO: 735440 - DNA, 918 bp, Homo sapiens
aggatccttaattaaattaatccccccccgcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagcc

SEQ ID NO: 735441 - DNA, 477 bp, Homo sapiens
gattagaaagggctggaaaggtccaggaagctttcatgaaggggttggacttgacaggaagtgtcacgttaaaaagtagagggccaggaaagggacaaggtagggggatggaatgtacagggcatgctgccggaggtccatggcgggaatagtagaacttaagcttgcagaagtaaatagcaccaaagtgtagagtcttgaacacccatccggtttgaaagcggaaatcctatgatgtggatacctggagccactggaagtttctgagcagtaggtgatgtctaaaaagccagattttaggcaagttcatctggtaatggaatttaggaaggtttgtaaaaatgacaccaggggacacagggcaggaaccagaattgtcagcaaaggtcacactcaagtaagctgctgctggccatgtaatttgtcacttcttcctttgcagaactcaggagcacacgatggccatcctccaagctt

SEQ ID NO: 735442 - DNA, 540 bp, Homo sapiens
caagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagctt

SEQ ID NO: 735443 - DNA, 703 bp, Homo sapiens
cttctttagcacagtttgaacaaaaatggacaatgctcataactcaacttccagatattcaagaaaaacttcaccagcttcaaatggagaaatgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagattttgaacaactggatggaagcacaagaagagagactgaaaactttacaaaaacctgaaagtgtgatctcagtgcagaagctgctcctggactgtcaggatatagaaaaaggactagtataggaatggagcttatcactgatccttccatcttgttcttggatgagcctacaactggcttagactcaagcacagcaatgctgtccttttgctcctgaaaagatgtctaagcgggacgacatcatc

SEQ ID NO: 735444 - DNA, 1007 bp, Homo sapiens
cttctttagcacagtttgaacaaaaatggacaatgctcataactcaacttccagatattcaagaaaaacttcaccagcttcaaatggagaaatgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagattttgaacaactggatggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcata

SEQ ID NO: 735445 - DNA, 348 bp, Homo sapiens
cacccctgccacatctggcatgattttaccgtccccttcctagagttctccctttctcccctgcccaggctgcacccctggagagcccagctcaggcccctggcccctatgaagcctctcctgaataatccatcagcctgccctgagctcatccagtctccagtgacgattgtgctctccaccagcaggacacaccggagcactttctctgtccctgagaattggactccattccacagaagtgcgcctgggtgcgcacccaggcgcacttctggtaggaagccaaggggccgccagaagatgtggctccactgagaagtgcgcctggtgcagaagtgcgcctgggtg

SEQ ID NO: 735446 - DNA, 565 bp, Homo sapiens
tgccggggggtctgagccccccaggcattcttcactgcatccctctccattgggggggtgtctaaggaccctttccccttgggcatggccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagtgggatggacaaaaccctcctctccctcattctctactgtcacagtggctccggaagcctggttggcattgacaacaaaatcgagccaaccgtggactagtgttggctagtgtgataagcatcagagtctcaagagactctttggggaggggcacattattctcatttaacacagcactgtttgtggcagcatcctgaacattggcatttttatgacttaataagctatcttcttttgtaaccttatgcactgcttctacttgagccttcaaaatgtta

SEQ ID NO: 735447 - DNA, 582 bp, Homo sapiens
cccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagccaaaaaaaaaaaaaaaaaactaagaggtcgacggtatcgataagcttgatatcgaattcggcacgagtcgtgggaaggtgaagagcttccctaaggatgacccgtccaagccggtccacctcacagccttcctgggatacaaggctggcatgactcacatcgtgcgggaagtcgacaggccgggatctagggtgaacaagaaggaggtggtggaggctgtgaccgttgaagagacaccaccca

SEQ ID NO: 735448 - DNA, 1057 bp, Homo sapiens
  misc_feature (66)..(66): n is a, c, g, or t
  misc_feature (71)..(71): n is a, c, g, or t
  misc_feature (74)..(75): n is a, c, g, or t
  misc_feature (89)..(89): n is a, c, g, or t
  misc_feature (91)..(91): n is a, c, g, or t
  misc_feature (105)..(105): n is a, c, g, or t
  misc_feature (107)..(107): n is a, c, g, or t
  misc_feature (115)..(116): n is a, c, g, or t
  misc_feature (119)..(119): n is a, c, g, or t
  misc_feature (123)..(123): n is a, c, g, or t
  misc_feature (125)..(125): n is a, c, g, or t
  misc_feature (129)..(130): n is a, c, g, or t
  misc_feature (133)..(133): n is a, c, g, or t
  misc_feature (135)..(135): n is a, c, g, or t
  misc_feature (138)..(139): n is a, c, g, or t
  misc_feature (145)..(146): n is a, c, g, or t
  misc_feature (151)..(151): n is a, c, g, or t
  misc_feature (156)..(156): n is a, c, g, or t
  misc_feature (161)..(161): n is a, c, g, or t
ccatccgaacactacacctttagcggcgcgggggtcacatacccccgcatttggcccccccccccnttttntgnncaaggcactttcgncncagggagggccatntngcccccgnngantgcnancctnntgngncanngtcctnngaacncgtgngcggncaccaaacgtcgttcggcacgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735449 - DNA, 3883 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcacctgagagtttatgagatttgagttgcagagaaaaaaagtatcttggacaagggggccagagagcgaagggaacagcatgaggctgaagaagaaacagcagatgttgactatttgagtacagtggctgggggaggggggactgaact

SEQ ID NO: 735450 - DNA, 4259 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctggagtggggaggaggtaagagaaggtaccctggagcccttccccacgtgggacctgtcatcttggaagcattactttaccattcaagacctcactgcccacagctcaaataaatatttattttttgagacagggtctcgctgtcacccagcctggagtgtggtggcgtgatggtggctcactgcagcctcaatctcctgggctcaagtgatcctcctaccttagcctcctgagtaactgagatggacaagcatgcgccaccatgcctgtaatcctagcactttgggaggccaagacaggcagatcacaaggtcaggagatcgagaccatcctagccaacatggtgaaaccct

SEQ ID NO: 735451 - DNA, 4781 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcctgtaatcccagcactttgggaggcagaggcgggcggatcacgaggtcaggagatggagaccagcctggccaacatggtgaaactgtgtctctagcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735452 - DNA, 4760 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggcctgcgaggacaggggtgtcagggctcggtggccccgtggcggcccccctgccaccctcccgctccgtgtttaccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735453 - DNA, 4687 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735454 - DNA, 4545 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgaggagcacttggcagcattgatgagctatgcccaaaacttccagaccgtacagcctg

SEQ ID NO: 735455 - DNA, 4530 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccatacctgtggggaccgaggcagcgggagggggcggggatgtcactgggaatcccttttcgtccgcgtccagggggcagacctggccttcctgcacccaccagcctcaccgcacacccttttaccccagagccagcaggtcctgggccaccgcggccccctcccacgcttccgccttcaccgcctccatgaaagtgtgtctcggcgcgccccctggcggcc

SEQ ID NO: 735456 - DNA, 4611 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagccacgctggtggctgggacgagacaagacaggtcggctcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcgctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735457 - DNA, 4649 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaacaggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctgtgagtcagccctgtgcccccctcttccctgccccatcgccattctgccatctccctctatatccccaagccctcaactgtgagccactccaataccctgcccctcttggcccccagcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggcttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgccccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaacatggttcttggtattgacgtgaatgggagcagggcatttggggactcaggaataggagatggggggcttgggtgccaaataccaaggaaagccttaaacggactccccagagattaccgatagcattagcatctcatggaggaccccccgcccccgaccaccagtccccctttacttcttcttcttcttcttgcgaccccaacactgggggcctccatcctctcttcggctcctccaggtgggcatgggaggctccagctcatttgggcggcccccccggtctggaacgttgcccataagcaccttgttgatggcacagcaggtccctctgcggacagcgggcagccagaacgtgtgcaatggagatgtccgattctggggtcagaacctctcgaattgggatcagcactgccctcatggcctctccttgggcctctgcccggtcactccagtggaaagcagatgtagtgaggtcaaggcgcttgaggaggaggcagcggcggcagcggtactgatctctgaggctttgggacagagactccaacgcttcccatctgggtgcatctagcgagcagctgaggaggggctgcagggaccctgggggcagagaaggctgcagctctgagatcttagcatgcaactcctgcagcagctggctggcgggggtccctggtgcaggtctgggcagccccagggcttggagggtaaggtccagttcttggaccatgccggctccctccactaccccttcaccaaggggtggcctaggactcggatccagcagagagcggaggcacaggaggcgggtggcttggagctctgagcagagaaagcgcagcaggcgcagtccggcaccgggttcccgaagcgcagccgcgccatccccgccgcagagcgcgcgatccgggcagtgcagctcccgcagcaggctgccgagctgccgcagaaagtcctcctccgcgccagggccgtcgccggcgctcagcacctccgcgcccgcctctcgctgctgctcgagggcgcccagcgtcgccagctccgccgccagccgcacgcacagccccctgaagtctgggcatgaggcgccccgcgacgccgcccccgggacacctccataccccagagccagcaggtcctgggccaccgcggccccctcccacgcttccgccttcaccgcctccatgaaagtgtgtctcggcgcgccccctggcggcc

SEQ ID NO: 735458 - DNA, 959 bp, Homo sapiens
tccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttccttacaaactcctaacaccatttacgactttgtcatcaatatggtcaactaagcttggtttgcatggctcctacttcctttcaccttccacttaggcagtgtctcccaagtcccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgtaaaaaaaatta

SEQ ID NO: 735459 - DNA, 2863 bp, Homo sapiens
ggctggtacggcccgggattttgcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtgggtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggccccaagggttatggctttcatgtctaggtgtggggacagaggagggagaggcagatcctgggccgggagaggatggccctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaac

SEQ ID NO: 735460 - DNA, 2547 bp, Homo sapiens
ctacaaacttcttcttgcctcaacatcatgagtaatcattgttaaactgctaggaaatgctgtgtgacattgttagctagagtcagtatgtatgtaatcatgttttaaggaattaactcacagtatatctagctacaaataaagctagtatactgtcctataaatttttctaaaaactaatctgtagttctaaaaacttaaatgtcactcttattttcccttacttttttttaaaggtacctgaaatgctgcacaatgatgctagtgaccatggatgtagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggccccaagggttatggctttcatgtctaggtgtggggacagaggagggagaggcagatcctgggccgggagaggatggccctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaac

SEQ ID NO: 735461 - DNA, 964 bp, Homo sapiens
ggctggtacggcccgggattttgcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaaaacattgaaagaaaaacttctagtttgatgctaaaattctggctaatcaagagagaaggcctcagactgggagccatgagcaggcaacaacagtatctagaaggcatttaataatgtggttttctttttcattgttttcattctgatgatcacatctcaggtacagtgcttgataccagctttccaattatgaaaattgcctttcaaaataaattgacttcacaaa

SEQ ID NO: 735462 - DNA, 3051 bp, Homo sapiens
ggctggtacggcccgggattttgcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggccccaagggttatggctttcatgtctaggtgtggggacagaggagggagaggcagatcctgggccgggagaggatggccctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaac

SEQ ID NO: 735463 - DNA, 3142 bp, Homo sapiens
ggctggtacggcccgggattttgcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggggaaacagtcaaacagctggggaaggttgagatgttgacccaagatggtacaactagtatctagtggaaccaggattcacacccaggcaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggccccaagggttatggctttcatgtctaggtgtggggacagaggagggagaggcagatcctgggccgggagaggatggccctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaac

SEQ ID NO: 735464 - DNA, 3103 bp, Homo sapiens
ggctggtacggcccgggattttgcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaaagccaaagtgaaaagagccgctggggtacgattgattggagagatgcctcaagaagatctgcacgcggtggtgaagaattgcttcgcggtggtgaatagctctgtctctgaaggcatgtcagctgcaattttggaggcaatggatttagaagtaccggtattggccaggaacatccccgggaatgctgccgtggtgaagcatgaagtcacagggctactgttttccaatcctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaatagaggcttattttcaagcagtcatggttcagactcctcccgcctgccttctgaccaacctctccccatcgttgccagtttgaaaggcaaaagcaaaacagacgtgtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggccccaagggttatggctttcatgtctaggtgtggggacagaggagggagaggcagatcctgggccgggagaggatggccctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatacgaaaaaaaaaac

SEQ ID NO: 735465 - DNA, 1926 bp, Homo sapiens
cacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcaga

SEQ ID NO: 735466 - DNA, 1298 bp, Homo sapiens
cacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacaggtatggcagggaccctaggagaggaccctgggacgtggagacccccgtatgagaacagggacaggagttgggcaggggcggctggaggaggtgtaggacttggggcaggtcggggcctgaggcctggccactctcggggtcacaccttacgtcctcaagcccctggggcccaggtatctccctgtctcctcctcagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctgtgagtggtgctggggacacagctgagtcctcaagggcagtgggagtgaggggtgtgtgtgtgtgtgtgtgtgtgtgtgtgtgtaaggaagacagagagaaacaaaacaataacttgagaaaccttgtgtgtggatctaagccttgggatctgcggggagtgagacaggacagccttccccgcgtggtgggtttctgtggctcttctttgggtacctcctgggcccatgcccatctcactcctcactgctgaagccaagtttatatctttta

SEQ ID NO: 735467 - DNA, 431 bp, Homo sapiens
cacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttgtcctctaagcgatcctctaga

SEQ ID NO: 735468 - DNA, 2396 bp, Homo sapiens
tccctcatgggttctgcaggatgaaggaaaggaaaggaaaagacagagaaaggaaggaaatagcttttcatgagcacctactgtgtaccaggtgcttccctggcatgagctctcgtaacccttatagcaacatgagtttagagcaagaatcacaccccgactttacagagatggaaactgaggctcagagaagtaagggacctgcccaaggccactcagcacctagaaagtgtgcctagcacataggaggcacacaaaaatatgtgttgaatgggtgaatgaatgagagaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtccaagagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccacccagtccaccccctacctgacagccagagtgggccatgccagatgcaacccaggtcatgccacacaggtagataaaaccatcttcagcccagccctcaggccctgtgtgctgggaccctgctgggccctctccagcctccccctgcgccaggcctcctccgtcacttcactctggccctgctgttcttttccttttagtttgattaactcactctgcccattccatgctcaaagctgtttccgtgaggaaaggctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatgggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagcttctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttaccatcgtgttccaataaaactatcgaaacagaaaatgcc

SEQ ID NO: 735469 - DNA, 2153 bp, Homo sapiens
cccaacttcatgctgcagtcgacctagagatccccggagtggagagaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtccaagagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccacccagtccaccccctacctgacagccagagtgggccatgccagatgcaacccaggtcatgccacacaggtagataaaaccatcttcagcccagccctcaggccctgtgtgctgggaccctgctgggccctctccagcctccccctgcgccaggcctcctccgtcacttcactctggccctgctgttcttttccttttagtttgattaactcactctgcccattccatgctcaaagctgtttccgtgaggaaaggctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatgggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagcttctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttaccatcgtgttccaataaaactatcgaaacagaaaatgcc

SEQ ID NO: 735470 - DNA, 1774 bp, Homo sapiens
gcgaattcactagtgattatccccggttccagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccacccagtccaccccctacctgacagccagagtgggccatgccagatgcaacccaggtcatgccacacaggtagataaaaccatcttcagcccagccctcaggccctgtgtgctgggaccctgctgggccctctccagcctccccctgcgccaggcctcctccgtcacttcactctggccctgctgttcttttccttttagtttgattaactcactctgcccattccatgctcaaagctgtttccgtgaggaaaggctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatgggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagcttctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttaccatcgtgttccaataaaactatcgaaacagaaaatgcc

SEQ ID NO: 735471 - DNA, 837 bp, Homo sapiens; identical to SEQ ID NO: 423156
  misc_feature (717)..(717): n is a, c, g, or t

SEQ ID NO: 735472 - DNA, 1462 bp, Homo sapiens; identical to SEQ ID NO: 423157

SEQ ID NO: 735473 - DNA, 612 bp, Homo sapiens; identical to SEQ ID NO: 423172

SEQ ID NO: 735474 - DNA, 282 bp, Homo sapiens
gtagtagcatgatcagcactgaattcaggccatctctgagccagtggccatgctctcagccctgcctccaatgctgcctcccacatgaaaattaatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtcctggggtggcatcgataaaca

SEQ ID NO: 735475 - DNA, 1275 bp, Homo sapiens; identical to SEQ ID NO: 423168

SEQ ID NO: 735476 - DNA, 2294 bp, Homo sapiens
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacaggtaagaagccttggcaggaggactgaggaagttttggaatatttgtatttcttcttttgccaactgtccacttctgtcctttgtccgtttttgttggcatgttctttaagaattggttttcttgagtagttcttaactgtttacattttgagattaaatttataaatcctcatttcacatatgttgaaatatttttcccacatgtcaatgaggacattttttggtttttgaaaacagtcctttgtccttttaagtgtgttgttttcagatggctttatatgcacatggcttattgcagga

SEQ ID NO: 735477 - DNA, 8916 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccacctggaagaaacaaaataataatccacaatttcaatgaacgctactggggaaaacaaacaatacttcattttagagaaagaaaggcagtatcttcagtggttcacaaacatcagaatgcattgagacctgcagagggcttgttagaacacagattgttgggctctacctccaaaatttctgattcctgtgtagaatgtaagtgtaaaagctttttcct

SEQ ID NO: 735478 - DNA, 9123 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttctaaaaatagaagtacacagattggctttccatgggctcttttttggggggctggaggaagaacccacacagatgtggtggaatc

SEQ ID NO: 735479 - DNA, 9130 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735480 - DNA, 9604 bp, Homo sapiens
  misc_feature (2077)..(2077): n is a, c, g, or t
  misc_feature (9588)..(9588): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggcggacgcgtgggtcgacccacgcgtccgctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaacaaagncccaggagcgggtgct

SEQ ID NO: 735481 - DNA, 6978 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaagtgaccatgtcattttcaagtgtcaagaatgtagactttggtactgaaacctgtctacatt

SEQ ID NO: 735482 - DNA, 5764 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacgtaaaaaaaaaaagaaaaaaaaaaaagaaaaacacaaaatgaatgaaaacacaggcgacaaccaaaagctcgaatagagagggagaagagacaacacaaaaaaaaccgcactagacaacacgcgaggaatacaacagacacaaaaacacggggaacagaacacgtagagaacagaaaggcaaacaaggacaaagagaca

SEQ ID NO: 735483 - DNA, 9440 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactggtgagaatctgaccagggagtttttgtacctcacattccaatgatgcagggattgagcctctctgttggactctttctcggcctgcttttaagttctaagtgtgatggcttgggcaagggtatttgctgatgattgtatttgctttgagtgttgggctgtccttcccttacccctgtcttggcctttgagttactcagttaaacccattttgatctgaagcgactgaaagcaggtcctggccaggtaacattacagcctttgaaggattaagatctttagaactaattgctcagaggatgaagaaccacaaagctgcatatgaggcaaaagtgtaattctggcctttcattaccagtgtgggctaggaagcagaggcttgagaggattggggtatgcaaaactattttttccttaaatttaagagtagaggctgggcatagtggctcacacctgtaatctgtaatcccagcactctgggaggccgaggtgggcaaatctgttgagttcaagatcaccctgggcaatgaagcaaaatccccatctctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735484 - DNA, 9224 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735485 - DNA, 9169 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735486 - DNA, 4913 bp, Homo sapiens
  misc_feature (2077)..(2077): n is a, c, g, or t
  misc_feature (4887)..(4887): n is a, c, g, or t
  misc_feature (4913)..(4913): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcattatctttcttgtacatcattatataantgtaaagctcattgatagcatttacn

SEQ ID NO: 735487 - DNA, 9177 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735488 - DNA, 9256 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagtgctgaagactgtgccctttactgctcgcaccgccaagcgtggctctcggtttttctgcgaacctgttctcactgaggaataccattactaaactattactctttctcacctgatgctcttaaaagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735489 - DNA, 3877 bp, Homo sapiens
  misc_feature (2077)..(2077): n is a, c, g, or t
  misc_feature (3852)..(3852): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagtgctgaagactgtgccctttactgctcgcaccgccaagcgtggctctcggtttttctgcgaacctgttctcactgaggaataccattactaaactattactctttctcacctgatgctcttaaaagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgttcaggaggttttctgttgcggtcacccatgatggcgggcctncccatttgggccaacttttcctggg

SEQ ID NO: 735490 - DNA, 3876 bp, Homo sapiens; identical to SEQ ID NO: 423177
  misc_feature (2077)..(2077): n is a, c, g, or t

SEQ ID NO: 735491 - DNA, 9151 bp, Homo sapiens
  misc_feature (2077)..(2077): n is a, c, g, or t
gcggccgcgggcccggcagaaggccgagtaggagggaccacgcgccgggggccgcgatctctggcagggggcggtgtgccagcggagcaccatgcacataggcgcccagcgccccgactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaacgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccncctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgtgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactacaaaaaaaaaaaaaaaaactcgagttttttttttttttttttgtagaaaattcctttattatagtgcaaattactttcagcagtgacataatgtaacaacacatttagcaacattttacaccacacagtaaataagaaagtgtttctttgaaaatatgtcatcataggaacattatttctacattaatgccagaaaatgccaaggccgtttatctcaaggcaaacagggctccctccttccttttgggtattttctttttaacacaaatgaaatgacttgccattttaacaaatcctcaattctaaaagtgatctctcagggggctttgaactaaggtcggcaagatttgaaatggggcttcaaaattttaaataataattttaaaatacttctggaatagcccaaaaagtagaagtcacttctattaagttttaagtagatatacacactcactccaattttactgtagaaatggacagattgtctaaagcctgctttctattcccccagagcctgattgttatttatactccttggttttggttattgcagaactagggctctggtcagaaataacaccttacatacccgaatactttcctgtggaagctttacattgcattttccatcctgaaattctcaccttagaccttacaggcccaggagagggtgtgaatattgttttcagtttacagctaaagccccttactaatttgggctatacctgaatcaaatcatcacatcatttagattaatcccaataggcttatccaagaggttcccactaacctcacagagaaacaaacagttaacattgtattttcacactaagctgcctaagggcttggctgctaatgagttagctgataggtagacagaataagcgtgtcaattccaatcagtacacgccctgctcctctagtttctgctgaattatgcagtgggtgggaatggttggccactcaaaacagtcttcctatggggctcttccaccataagttggatcaaaactccacaaatgtatttcaaggtgccctttaagtctctcaaatttagggacttttaagtgacaagccatgagaagttaatcacaggcttgaaaatacctggaaccacagaacagcccccacggaacaggctgaatatggttaaataagttggctggtacataaagcttttcaatgtacagccagtcttgttggatacagtgtcttcttatataatacaatggaactgtgctaaacagtttcaaagttgagaagaatccaaatgtatcacctataaaaaattcataattttagtttattttagactttggtactgaaacactgtctacattcttgacacttgaaaatgacatggtcacttcagtgcctctgcatgttgtgtaaaaaaaaaaaaaaaactcaaaaaaggaaagcaggacaaggatgtgtcattacaagacacagtatgctgtacaaacaaaacctaaattatatataaatacacccccaccccagaaccctgtcttccctcactacctgatcaaagcaatgccaagggtccctccctccagggccaatgtagcttttaaagtccagaacccaggactttaagcatcccttgccttgcggtgacgtttacagtactgcaacctcctgttggagtcacctgtttgatcagttccgtaagtgcagggtaacacctacagcttaattggaagcattcactctactggctggattcaaagacctggagtcctgggagttaacctttcagataaactaactggatcatttcctaatctggatcctatctaatcctactatctcctcagagccaacacagtaggaagcatcttctactctgaagcttccaaaggcattacttagggatattggtgagggtcacataagaaaagttatacaatgagctaacagcttaagttgatataaattacttccaagtaagttattcagggccgtttgcttctgctttacactgcattccacagtcattttcatattattcttttaaaagtttatactatagtcactttaaaaattgtctaagcaatcacctctttgtgtttttgattaataacaacttaatgagctattatataaatcaagagagaaataattagtcttaaggaagccaataatgtgctaattcccagtaaggagaaaaagcaatgtaaatagaattttacataaccaacaataacttggaaagcagttttatcaaaatggttttgcaaaggtttcccaaaagcacttacagcagtttatatcaagagatcctaagtttaggggtatggagaatctcaattctttaaagcagaaattcacctgtttcataattgtaatatgtaattttctccccttggacctaagatatttatacattcaaaagtttacaacttgctgttcttgagacattgttcattctttaatacatacattgagtataaataaataactacaagaaagcttcaacaatctgaattaacattatgctgtgcaaaacaaaaacaaaaacaaaaacaaaaaacaaaaaaaaagtcaaaccttgaacaacctacattctatgtaaataccctgactaaaatattggttgtgctacacaattccactttagtgcagaaatgcattgatttcactgtaccgttgttgttggctttttaagtgtctttagcacttctgtttctaagcattgccttgctttgaaaagatgaataatttgctaccaaatcacaaatcatcacaaatccattttagtttggtctgaataaaatccagcataaatgtattattttattctgggtataatggctcggtgtctttgtcccaacagctttcttcttaagggcaaaccacccttaagtgaaacttgccatttgtttttgttttctttttaagtctccagatcttgctaggacacttcttccagaccaacagtcagatagttgtggcacgtgatcctatttgaaatagaggtggtttaaatcagccaagcttggtgatctggaggtctccatttatctttatggtgtcaattgcagataacgtttgaatgcgatggtaaaaatcaaaaagttggtgtccatccacaaacactcggaaacgtgggtgctcacaaagaatttccaccctgaatggctggtctggaatgaatggaaagtaagggattgctgactgttcttcacccctctccccagatatacaagaatttctgagtagctgccgatctgtgaacacagctttgagttcgattgccacatcggcaggagggtcttctgagtccccacaggtcaagctgattgcaaagctctctgggttgaggtctacgatgcccatcactaacaccttcttgcctggtctcatgccacctttaatgtgcccacaaaatggaactatcagtcgtgggaagtacacgtccgcttgaactggagagctcaaagagttgtttaaatggccatcatctagtttcaccacggcatcgctgtcggccactgatcccgccatcttcttgcccggcgcggcggggtacgtgggacgcggcgcgcgggcggggatcccgg

SEQ ID NO: 735492 - DNA, 1419 bp, Homo sapiens
cgatgtcaactataagcactccctgcagtctccaaccggggtcctagttctagtcttccggacagctctaggactcagttcatttaaagatcattggtgttggacacaactctcacccaataaacaactcagcaccagctcctcctggcttaggggagcagctcctctgcttccccacatgctctccagaagggtcaagagcgcccctcccagaagagttctaaatgtcccagctgatggcctcccatagacattccatgctggccacagttgcaggcctcagatgggcagccaagcccagtgctgacccatgagcttctccacctctctgcgtcaggagtcaggtgggggtgctgaacagaccctgtagcatggctcctctagcagtctgggccccagggacatcccttttagccccagtggatccctgggacagaggcaagggcggggggaaggggagggaagacccaagagcaatacaagtgatagtctctcctgtcccatgccttcacacatgcagggaccttgccacaagtccccttcctcacctgcatatctggggaattcctttccatctctgaagtcatagtttatgctgcacccctatgtggtctttcctgacgaccaggctctaccaccaactcaaaataatcagtcccttgctccttcctccaccctcaaggatccacatccacaaagaaaatgtgctacatatacactgatatggtttggctgtgtccccacccaaatcgcctcttgaattgtactcccataattcccgcgtgttgtgggagggagataatttgaatcatgggggcagtttcccccatactattgttgtggtagtgaataagtctcacaagatctgatggttttatcagggatttctgcttttgcatcttcctcattttctcttgccgccaccatgtaagaagtgcctttcacctcctgccatgattctgaggcctccccagccatgtggaactataagtccaattaaacctctttttcttcccggtctcagatatgtctttatcagcagtgtgaaaacagactaatacatgcaccatggaatactacacaggcatcaaaagaacatggcctttgcagcagtgtaggtggagctggaggccatcgtcctaagcaaattcacgtaggaacagaaaaccaaataccacatcttctcatttataagtgggagttaagtattgagcacacatggacataaatataggaccagcagacactgtggactactagagggtgtgtgggggggttaaaaacctatatatcaggtatatgctcactaccagggtgacaggagccgtactccaaaccccagcatcatgcaattttcctcagtaacaaatctgcacatggaccccctatacataaaataaaaattgaaataaaaatcca

SEQ ID NO: 735493 - DNA, 1142 bp, Homo sapiens
gtttgttttctatttttctcatatattgcttgttcctcagtccttcttttcctgatttcttttacgttaaatgtttattttaccattttaattctgttgtctttttaaagctacatttctttgcattcttcttataatgattactatagggactataatatgtgtatttaatttatcacaatgaaaactatttgcgaattaaccttggttttacatatataaatcttgcaacactaaagttctgcttacctcccgtctatcctttggtgctatagttgccatatacattacatctatattttttaaaacacaaaatgcagtgctacaagtttgtctttaagaaactaagaacagtatgaaaaggatgttaaaatatctgggtagttattaaaataaattatctctaaaatgaattttgtaatctattattataattttactagttagaattttcaattgttattttttatatctttaagaggtgaaccgagtatagagtatagaacaagaaaaatgtcaggcagtcagctggactcacttgttccctggacgaatctgtttcagttaaatgacagatcaccataatcatatggaccttcaggttttcccaccaaaaggccaaactgaaaatacgaaattcctgacccataaatatcttactgcattgtaaatcatttagcattcattaatcactatttacaattttttaaaaaaaataaggcttgtgccttttctcatctgtttagaatattcagtttagtaactgtatggcaacgtaagttactgacagggaaagccttgtaagacagtactcatttacttaaaatgtggagtttttgcatttctttacaattgaatggaaaaattaccagcagtgctttgggttatagtgacacctggtggtacggtttgaggttttaaaaaaattctttttaaatttgttactcttttttttttctagaccattttttgtaaggaatcattttatcaactaggatgacaagaggcctctcccatcctggttgcacatcactttctataacagagagacatgggccagaagccctgatggagaaagcagccaatgtcccttacatttccacctttggcttgaaaaaaagatctgtgcactaaatacaggg

SEQ ID NO: 735494 - DNA, 1957 bp, Homo sapiens; identical to SEQ ID NO: 114732

SEQ ID NO: 735495 - DNA, 191 bp, Homo sapiens; identical to SEQ ID NO: 114733

SEQ ID NO: 735496 - DNA, 2169 bp, Homo sapiens
ccaaatgagggaccacacagcagaaagatgaagcccaggctcctgacacactggagttcacgcttcagcttgtgacctctgtgggccagttcacctcagggccaggcgtcactgagactgtgggttctgggagccctctttgcttttactgtcctctgccgggctgcactcggaccccgtgatggaggacttgcacccgcgaagcacgtgggcattcagcatctccagcagcaggtcatacactgggaccacatttttgcacttcatgttgagcagatgttccatgcccttgttactcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatccctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttgcagataaacacaccggccttgccttctctaaaatgcggacacgtgcttttcccgcattagggggggtctcccggcgcgcgccccgccgccacctgttgaggaaagcgagcgcacctcctgcagctcaggctccgggcgccagccctgccccgcagccccagagcccgtcgcagctcgggtggtccctccccggcccagcgctcgccgcctgctcttcgccctgcaagtttcaagaggcagttatttctcgcagcctccgcgcttgcaactgcctcctggcgggggagtgggtgtccaaaaagccagcagctggagaaactgaaaagatcacaagcgacttaacgataagccccttcttccttttaaagaccgag

SEQ ID NO: 735497 - DNA, 1992 bp, Homo sapiens
ccaaatgagggaccacacagcagaaagatgaagcccaggctcctgacacactggagttcacgcttcagcttgtgacctctgtgggccagttcacctcagggccaggcgtcactgagactgtgggttctgggagccctctttgcttttactgtcctctgccgggctgcactcggaccccgtgatggaggacttgcacccgcgaagcacgtgggcattcagcatctccagcagcaggtcatacactgggaccacatttttgcacttcatgttgagcagatgttccatgcccttgttactcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatccctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735498 - DNA, 1605 bp, Homo sapiens
taaagccaaaataatgaaacactttatttatatcatgttaaactctctacgacagtgccatagacattaaagggacacagtaaggaaaacactccctggaggaagggaaagcaggtctcaaaatctgctttcacagagcagcaaacattcatttctacaaggcccaaatgtaaagcctgcaaatgaagtcaacaaattagtgtaatgatacaaagcattcgtctgagaaaatggcaaattatagccaaccaacaggctctgaagtacacattgaatgacaaaaggtataggaccaacagttaaggcatttagacacccaacagaggaaacaaatgcaaaaacatccattgtacagttaacaggaactgttcgcggctggtatcaccactccttatgtgcttcccatagaggaaacccaccaccagtttaccagtggctggccctacaagtgaataggatcctcggaattaaaaaacaaacaaacaaacaaacaaaaaacctccctgactccaaagcaacaaaaatggcactacgatcatacatcacagacaatgcacatcttaagagctgccactggagccaaaattccagcaagtttgagagctataaagaataagtggcacgtgttttcacactgtagtatatcacactccacagggaagcagcagtgcctaaaagatgtgaattttacatgagtacacttccaaggaacatattccacgtgtttggggaaagcagtcacagacaggaggtgatcacagtacccactagagctcatgaacctgagatgggacatgggaataacagattatgcatcttattttccatctgtcattgctgctgttgtgtaaaggctcatgcagacccatctaagctgaggagatgggatctaaaggtacagcagaagacaaccctaacttcaccgcccctccattctgctgcgactcagctcacaaagcagattctcacagaagcaagtcctggggcaggagcaatactggcccgctaggcaagcagaagacttgcgtgccagtccaagctttgccatgagtagttttatgaccttgaataggtgaatttgcccccgtgggctttaatttacacagatatgaaaggtggagttgaactttgatgtgagaggtttacaaacttactgtgtctgtaggggtgttctggacattgtggtgggaggtaagggggtatcacaagggggccccatttaaatcacagcagccgtgcatgtcaggttgcacctgatagattctgcagttttaaaatatttttctttaaatttttaaactgtttgaagtgcatggtcactgtcagcactggacttggactgcctgtgttcagctcaatcacctactccccacgtgaccttcagcaagtttgcttagaccgtgtctagttccacaaccagaaaataaggaaatagcagttattataataaggattaaatgtgaatgtctgaggcactgagaactgtgtctggcacagatattatctttagatactaaataatgtgtttttatctttttaaaagattttcagcaacttaaaaaaaaatgtgccctcggccgattcaccccgcctcgactagcgtta

SEQ ID NO: 735499 - DNA, 1455 bp, Homo sapiens
tttttgacaagtctcactctgtcagtcacccaggctggagtgcggtggcccaatctcggctcactgcaacctttgccttccaggttcaagccattctcatgcctcagcctcctgagtagctgggattacaagcacacaccaccatgcctggctaattattatatttttaatagagacggggtttcgccatgttggccaggctggtttcaaactcctgacctcaactgatctgcccacctcggcctcccaaagtgttgggattacaggtgtgagccaccgcacctggattcccagccctctccatggcaaatgaacaggcaaagccccttgttgcccatttaagtccagtagcattttactttctacctaaacaaagaggataggcatcggcatttcccctttcttattggaagatactgaacacagttcctaacctgcatctgttggcaggcacagctgaccacacaatcccagtcccctcctccccttctctgccaaagcacaaacctcaggggaaaccagtgaagctcatcagtagatgaagcctcagctttctacattggtgcccctcatgggtgagacatctgcaagccctgggcagttaaggagaccatctgaagagaatccgtcttcactttagcgtttacagttatcaaattgttggattgataatagaaaggaaggtggtttttaaccacataactaacttcaaagtattttaactctttctttaaaattatttttttcatggattacaatgatcccagagggaaattgaagtgaaaatgttacccaagatttttctttaggccaccgagttgattagagggtcactgctccatcgttgcttcaggcaaaagagtctccatcttcattccaaatgaggtgagtgtttgagaggccttttctgccctcgcatgcctgacgtgggacaggagcatcaggagctgtttacaggtaaggtgtgttctagcgatcttgcttcacaccagggactcttttgaggttccgcatacagatgtgataactggcgatggaccactgtcttgtaaggcagcatgctcttggggttttcctcataacacactggactcttcttttcaatcttccctcctgtttccttctcatctccttgaattctaaacactgcagtgtcctaggcatcggtatttggttgtctccacctaaacctgttcctttggtgggatctcatccaatctcatgaatttaaatgccatatctccacttggatgtcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735500 - DNA, 2786 bp, Homo sapiens
tttttgacaagtctcactctgtcagtcacccaggctggagtgcggtggcccaatctcggctcactgcaacctttgccttccaggttcaagccattctcatgcctcagcctcctgagtagctgggattacaagcacacaccaccatgcctggctaattattatatttttaatagagacggggtttcgccatgttggccaggctggtttcaaactcctgacctcaactgatctgcccacctcggcctcccaaagtgttgggattacaggtgtgagccaccgcacctggattcccagccctctccatggcaaatgaacaggcaaagccccttgttgcccatttaagtccagtagcattttactttctacctaaacaaagaggataggcatcggcatttcccctttcttattggaagatactgaacacagttcctaacctgcatctgttggcaggcacagctgaccacacaatcccagtcccctcctccccttctctgccaaagcacaaacctcaggggaaaccagtgaagctcatcagtagatgaagcctcagctttctacattggtgcccctcatgggtgagacatctgcaagccctgggcagttaaggagaccatctgaagagaatccgtcttcactttagcgtttacagttatcaaattgttggattgataatagaaaggaaggtggtttttaaccacataactaacttcaaagtattttaactctttctttaaaattatttttttcatggattacaatgatcccagagggaaattgaagtgaaaatgttacccaagatttttctttaggccaccgagttgattagagggtcactgctccatcgttgcttcaggcaaaagagtctccatcttcattccaaatgaggtgagtgtttgagaggccttttctgccctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatccctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttgcagataaacacaccggccttgccttctctaaaatgcggacacgtgcttttcccgcattagggggggtctcccggcgcgcgccccgccgccacctgttgaggaaagcgagcgcacctcctgcagctcaggctccgggcgccagccctgccccgcagccccagagcccgtcgcagctcgggtggtccctccccggcccagcgctcgccgcctgctcttcgccctgcaagtttcaagaggcagttatttctcgcagcctccgcgcttgcaactgcctcctggcgggggagtgggtgtccaaaaagccagcagctggagaaactgaaaagatcacaagcgacttaacgataagccccttcttccttttaaagaccgag

SEQ ID NO: 735501 - DNA, 2470 bp, Homo sapiens
tttttgacaagtctcactctgtcagtcacccaggctggagtgcggtggcccaatctcggctcactgcaacctttgccttccaggttcaagccattctcatgcctcagcctcctgagtagctgggattacaagcacacaccaccatgcctggctaattattatatttttaatagagacggggtttcgccatgttggccaggctggtttcaaactcctgacctcaactgatctgcccacctcggcctcccaaagtgttgggattacaggtgtgagccaccgcacctggattcccagccctctccatggcaaatgaacaggcaaagccccttgttgcccatttaagtccagtagcattttactttctacctaaacaaagaggataggcatcggcatttcccctttcttattggaagatactgaacacagttcctaacctgcatctgttggcaggcacagctgaccacacaatcccagtcccctcctccccttctctgccaaagcacaaacctcaggggaaaccagtgaagctcatcagtagatgaagcctcagctttctacattggtgcccctcatgggtgagacatctgcaagccctgggcagttaaggagaccatctgaagagaatccgtcttcactttagcgtttacagttatcaaattgttggattgataatagaaaggaaggtggtttttaaccacataactaacttcaaagtattttaactctttctttaaaattatttttttcatggattacaatgatcccagagggaaattgaagtgaaaatgttacccaagatttttctttaggccaccgagttgattagagggtcactgctccatcgttgcttcaggcaaaagagtctccatcttcattccaaatgaggtgagtgtttgagaggccttttctgccctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatcccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735502 - DNA, 3593 bp, Homo sapiens
tttttgacaagtctcactctgtcagtcacccaggctggagtgcggtggcccaatctcggctcactgcaacctttgccttccaggttcaagccattctcatgcctcagcctcctgagtagctgggattacaagcacacaccaccatgcctggctaattattatatttttaatagagacggggtttcgccatgttggccaggctggtttcaaactcctgacctcaactgatctgcccacctcggcctcccaaagtgttgggattacaggtgtgagccaccgcacctggattcccagccctctccatggcaaatgaacaggcaaagccccttgttgcccatttaagtccagtagcattttactttctacctaaacaaagaggataggcatcggcatttcccctttcttattggaagatactgaacacagttcctaacctgcatctgttggcaggcacagctgaccacacaatcccagtcccctcctccccttctctgccaaagcacaaacctcaggggaaaccagtgaagctcatcagtagatgaagcctcagctttctacattggtgcccctcatgggtgagacatctgcaagccctgggcagttaaggagaccatctgaagagaatccgtcttcactttagcgtttacagttatcaaattgttggattgataatagaaaggaaggtggtttttaaccacataactaacttcaaagtattttaactctttctttaaaattatttttttcatggattacaatgatcccagagggaaattgaagtgaaaatgttacccaagatttttctttaggccaccgagttgattagagggtcactgctccatcgttgcttcaggcaaaagagtctccatcttcattccaaatgaggtgagtgtttgagaggccttttctgccctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatccctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggctgtcaacacaacctgcgctgcgattggacagcgcatgtcttacatctctagcattctccatggtccataacacccacctagcacaatccacgcgttcaacaaatgtttgctgaagcctttgacttggaaagatcagagggagaattttccgtaggaaagaaactaccaagaggcaaaacaaaaccctacctgcacatcccatgttttctccactgtcatgagatgctgttcttatttgttgcataaatggaggcatgtctgtcctgtagagcccagatacagggctaattagagggcgctgatctcctctggggtctcttctgaattacacagtgcatgggcccagccttgaatccttcccttggagtccctcgttcttccactttagcactgtggaagcttcattcagggcacctgtaggctacaaactacctccatctgctctgtttttcaacctaaccttgtggctgggagaagagagcccaggatttctgtgttctcgctccttaatccatgtgcattctcctcctgctccctctatcgtcccttcaacctccagtcctggatagcgttaagggctcaaattctaacaaggatcacctgctagagagttggttcagaatttctaaagactttaagtgatcattcttttccacaacaggttgatgtctccctcttacaaacaggccattctcagtcttcattttatttgatcagtctgtaacatttaacagttaattactctttctttcacagaacacatttttcacctgtcttgtaaggcagcatgctcttggggttttcctcataacacactggactcttcttttcaatcttccctcctgtttccttctcatctccttgaattctaaacactgcagtgtcctaggcatcggtatttggttgtctccacctaaacctgttcctttggtgggatctcatccaatctcatgaatttaaatgccatatctccacttggatgtcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735503 - DNA, 434 bp, Homo sapiens
cttcatagtggcacttttattcgcggcctcctggcactgtgctgagtgtcttccttctttcctcttcctcattttggggccctggcatttagtttaaagctggtcctcgtattcagtgggtaaggccagaaaagcaaatgactgtgatggattggaagcagtaagccatgttcctggcacaccctcttccagggctctaagacacggccgcgctctgatgtgttgttttttaagggacttccaccagttgagtcaaaatctgctgctgtggttagcgagtgccaagaaccggaggcagaaggctcatgtcaccgatccaaaggcagacccccgggctctcctagagtgtcggagggaactaatggtaagtttcctcccaagggctctgtactgccaccagcctctgtcagccccagagaggcagcacactcagg

SEQ ID NO: 735504 - DNA, 423 bp, Homo sapiens; identical to SEQ ID NO: 373618

SEQ ID NO: 735505 - DNA, 1552 bp, Homo sapiens; identical to SEQ ID NO: 373620
  misc_feature (497)..(497): n is a, c, g, or t

SEQ ID NO: 735506 - DNA, 684 bp, Homo sapiens
  misc_feature (543)..(543): n is a, c, g, or t
tcgtctagaggatctctcataggttcgcaggacccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgaacctatgatcataggttcgcagggggagtggtaaggagaggatggtttgggctccttcctctttttagaaatatacaagcagaaatctcattctctcaagtngttataaaatgtgcaaaatacaagcctcctttgcccagaggcaccatttacatctggtattcacctttgctaagagatagagatctatatatactccacgtgctcacgcacgcgtgcactcgcagccaagctcacacaatt

SEQ ID NO: 735507 - DNA, 315 bp, Homo sapiens
catagttttagaagtttcatagcaatgcgattgaaacttctaaaactcccaggcagcaatgatagactggattaagaaaatgtggcacatatacaccatggaatactatgcagccataaaaaatgatgagttcatgtcctttgtagggacatggatgaaattgaaaatcatcattctctgataattccatggcacaaatcctcacaccagactcactaaacactgagcaaggcccagaatgttccctaaggcccaaccaaacagaagagggcaccacacctgctattgaaacttctaaaactagggggtaccgag

SEQ ID NO: 735508 - DNA, 344 bp, Homo sapiens; identical to SEQ ID NO: 203625

SEQ ID NO: 735509 - DNA, 2695 bp, Homo sapiens
  misc_feature (606)..(606): n is a, c, g, or t
  misc_feature (739)..(739): n is a, c, g, or t
aaatcaaatttattgaggtataatttacatacagtaaaaatattaatacacctattttaagtagcagttaggtaagttttgataaaagtgcagttgtgtaaccaccaccgccatcaatataaggaacatctccatctcccaagacgtttcctcctgcctctttgcagtcaatcccctttcacctgtcttcaaccctaggtgatcactcactgtttcctattactatagttttgccttttctagaatatcatatagagggaatcaaacagtatgtagtcttacgtggctcacttgtttcacttaacataatgcctttgagattcatccaggttgttacacttaatgcatagttaattatttgattgccaagtagtgttccagttttggaaataagtttggaaatgagtagtttgtttatctaccagttaatagatatttgggttgcttccagttttgagctatatattagctatttttgtgtaacatattactccataagttagcagcttgaaacaacaaacttattatcacagtttctgtgggtcaggagtccatgggcatggcttagctaagtatctctggctcaaggtctctcatgagaatgcngtcaaggtgtcgacaaaggctgcaggctcatctgaaggctcgacttgtgtgagggaggaggtgggatctgcttccaagctcattcccgtggctgttgacaggcctcaaaagatctgcttctacttacagacangtgggctcctccaggagtctgcctcacaccatggcagctggcttccctcagcataaacaatctccaagagagtgagagagagctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatactggaattgagcaggatcatggccttgacacagagatattctttgtgttggagttttaactctcgaaaccttgaagtagttgccaggagcatgtcaaagatttccagaattccttctacgcatttcccctcatccctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttgcagataaacacaccggccttgccttctctaaaatgcggacacgtgcttttcccgcattagggggggtctcccggcgcgcgccccgccgccacctgttgaggaaagcgagcgcacctcctgcagctcaggctccgggcgccagccctgccccgcagccccagagcccgtcgcagctcgggtggtccctccccggcccagcgctcgccgcctgctcttcgccctgcaagtttcaagaggcagttatttctcgcagcctccgcgcttgcaactgcctcctggcgggggagtgggtgtccaaaaagccagcagctggagaaactgaaaagatcacaagcgacttaacgataagccccttcttccttttaaagaccgag

SEQ ID NO: 735510 - DNA, 648 bp, Homo sapiens; identical to SEQ ID NO: 109639

SEQ ID NO: 735511 - DNA, 1010 bp, Homo sapiens
aatgttgaagttcaagtccaatggctgtctgttggcagaatttttctttgcttgcagaaggtcagtcttttggtctcttcagatgttcaactgattggatgagccccacccaaattatgaaaggtaatctgctttactcaaagtccaccgatctaaatgttaacctcatccaaaaacatcttcacagaaacatccagaataatgtttaaccaactatctgggcaacacagcccagctaagttaacacataaaattaatcatcatggcagcaggcacctgtaatcccagctactcgggaggctgaggcagaagaattgcttgaacctggcaggctgaggttgcagttagccgagatcataccactgcgttccagcctgggtgacagaggaggactccatcttgatctcttgttgctggctactgagtttagtctcttagtttgagtaaatatttgtttcccacttctgtttcaggctcctatgttttccttttaaaagtgatcttacaaacaggccattctcagtcttcattttatttgatcagtctgtaacatttaacagttaattactctttctttcacagaacacatttttcacctgtcttgtaaggcagcatgctcttggggttttcctcataacacactggactcttcttttcaatcttccctcctgtttccttctcatctccttgaattctaaacactgcagtgtcctaggcatcggtatttggttgtctccacctaaacctgttcctttggtgggatctcatccaatctcatgaatttaaatgccatatctccacttggatgtcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735512 - DNA, 2315 bp, Homo sapiens
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgtaagttcttttgattggttgcagctttatttagatatgattcatgtaccacacaatttactcattgtaagttcataaccaattgatttctgg

SEQ ID NO: 735513 - DNA, 13601 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaaggtaaaacatttaaaaatagagttggtcattcagtggttttatgactgggagaattaagagtgtttcttttaaaaattgctcatagaactgtgaatgtaat

SEQ ID NO: 735514 - DNA, 13730 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtcagtctgtatctacatggtgcaaatagcctgtttatctttgaaaatccaacaagcattcattaaataaacatgtatattctccag

SEQ ID NO: 735515 - DNA, 18070 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtaagtcagctcactgcagggcacggctgtttgggagtggattgaaatgtctctgaaggccagacaaagtagaaaggagcttaatttcattgaaccggaggcccttttcagtgggacccctggcccggccgctgctc

SEQ ID NO: 735516 - DNA, 22081 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagagacttctgttgtactgaattctg

SEQ ID NO: 735517 - DNA, 22100 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagaaaaaaacaacccccccaacccccacaccaacacacacagggc

SEQ ID NO: 735518 - DNA, 21940 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgagcacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattatattgcatggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagagacttctgttgtactgaattctg

SEQ ID NO: 735519 - DNA, 21899 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctgtaaaggatataattctaatcaaactcagaatgattacagaaaatctatccaaataatcgatgcactggataccaggacttttgtgagctgcattttacttgtatacacaggacctgtggtcataaatcaatcacaagtgtgagattagctgactaaagatgaaattgttctttttaagaagatacattaaagcagagcttcttaactcttctgaaattgtactcaagcatttgtgttcaggtgccctttcccaggaagactagccctggttttcatcaaattctcaaaggactctctaaccccacaataagaattcagaatagaatgtagacactacttagcctaattactgtaa

SEQ ID NO: 735520 - DNA, 22162 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatacctggacaaagaataaaagccagaagtcattgctctgagcaaaggagcagaagtcgtgtgctcagctgttccgtgcgcctgctccgaggtgatctgggttgctttgacagctgcatgtgtggcaggagcttataagcatggtcttacctcccccaggggatcttccctgagagccagccccgtcacagagctagaagagaagcctggcctaatgcagacagactaaattgccacctgaagtgtccaccaggcccataattgtggccttgccgtggcgagtatatctagtctcccgaaatcattacgtggtgtttctcatctgcagcaacagatacagagatggtcagaaggtgagattaattctacttttagccccacggagggctccccatctaaagggagtttaataaacaaaggaatggccaatgtgatgaagcctcc

SEQ ID NO: 735521 - DNA, 23230 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatacctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggctgtaaagaaacacagaagatattgccaagttagagctacagctgttaactatgaaaatttaaatattttcattaaaaaaatacatacgtttgtatgagattacaaatacatcctgaaaaatatacatgaaaatattaacctcagaggagtgggaatgtgaggcatgaaactcacattttctgcttcattcatctcttcattgcttgtttgtttaatcaagagtttaagcacaagagtttaatcacgaaaatttattataaaatagtctttaaaaccaaaaaacacaggattaaataaaaatgaaagttcttatggaaaaataagca

SEQ ID NO: 735522 - DNA, 23104 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatacctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgtatatggagccgtgctccaggggtaagatggattgactgcagttgtaggaggaaggagaattaaggctagatggtgagttttttatatccatgtcttgagataacagctgagaaaacaccttgcaagaagaggcacaaaggtcattataatgttctcaaagattcgtgggcaagtataatggcttcagaaccatattgggatgactgtaacctgagcgcggttcctccagcagagcaagcacattcatcggactcagtaactcaaggggccagtcctctccagcatcccagctgccgccgccctgtcaggcttcccaggcaatcgcccatcttattccttctccagtgtggacgcctacgaggagggagcgtcccctctcgct

SEQ ID NO: 735523 - DNA, 22814 bp, Homo sapiens
  misc_feature (6127)..(6127): n is a, c, g, or t
  misc_feature (6702)..(6702): n is a, c, g, or t
  misc_feature (7072)..(7072): n is a, c, g, or t
  misc_feature (7297)..(7297): n is a, c, g, or t
  misc_feature (7404)..(7404): n is a, c, g, or t
  misc_feature (9565)..(9565): n is a, c, g, or t
agcccgcggggtgaaatgacttgctcatggtctggtagctaatcgcagatctgctctctaactcctacttccaagacccaggaatctacgggtgttggagaagacccctcctgaaatcctccagaagagctttttgagggagcttgtggctcctgttcacccagccccggttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaanggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaantaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagnggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacancattctcaaatcaaaacgctcaacagaaaagaaaggaaagtttactctgccaggcagagagaagcaggccacttctgatgtgcaggagtctactcaggaatcagctncagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcggtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaaggtaaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcatncaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatcatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacgcatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagagttcagagcagtgagaactacagaaggcgaggaggagacagagagcaggtaacggggctttaccgtgacagcagtgcgttcccctgctccacactcccactgactcagtcttgccaatgccactatcaaggtccttgcaaaaatctggttttcttttgtctggaaagggctggttttctcctctgaaactgaaccccaactgttggccctatttaaatctcaggtcttggatttcttacttacataagcaggggcttaggtaatagagtgggttgtgcctgtggagcctcccaatcagctctcaacctcctctgttggcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggccaccgagttgattagagggtcactgctccatcgttgcttcaggcaaaagagtctccatcttcattccaaatgaggtgagtgtttgagaggccttttctgcccttaagtagagatgcgggacaagtcaaagttgcagtgaaaggaagtgtggtctgcatttcaaagcttaatattgtgcatgtcaatttttgtctcttcctcaggataagggcctttaagctggtttgctccccatctccagggaggccactgcagcttctttcactcaaagctcagtgtattcccaaaactcttttatgaggtagtctgggttttatatcgtctgcaaatctttcattgcccacatgcaagggacattttcacatgactcttggcactaagataacttcaaatgaatgaattgcttttctccccatctcgcatgcctgacgtgggacaggagcatcaggaggttagccaggcgcatggattgctgctgggaggagatgccgctcttggcaatcacccaaaccaaagcatcggtcacggcgttcagcaagtgagccagcttccggctgctgtcagcatcctgggtcgctgtgaccagagggtacatacctgtccagaacaagatctggagcaaagatgagcttgccggggtggtcaattgagcgccacatcagccccatcattaacacctccatccaacagctctccaagagccgcacttggtcgaacaggctgagctccacaaagccgggaatcttcttggcccagctgatcatgtgtaccaactccttgtcggccaacttggtcagggacatcatcatggaggcctcggtgaagggcgcactggggcggctgatcagcacatggggcggctcagcctccaggagggtgagcactagctgctcggggctcagggcgtccagcagcagctcccgcactcggggcgcgtggccgccacttctcttggccttgccggcacagtgcagctgctcgtcggcacttctctgtctccgcacaaggcggtacccacatctctctctccgggagccacacttcaccattcccacttcgtaacacttccgaagtcggcaggcctggcagctcttgcgccggtttttatcgattgtacactgatttgtagctggacaaatataatcattatgtccttgaatgcttcttttaaaaaaggccttacatccttcacacgaccagactccatagtgatatcccgatgcgtaatcgctgcagacagcgcagaagtgagcatccctctttgaacctggaccagtaacagggctggcgcaacggttcccactaaccttccttttcagtgtctctctgtttacaggtaaggtgtgttctagcgatcttgcttcacaccagggactcttttgaggttccgcatacagatgtgataactggcgatggaccactaaaggagaaaggtgcccaggtgttggccacaacacatttgggcttgtggtctgccgaccaggcccaccttccaagttagtgacattgctgggaatgctgtaattcatcacagcagggctatagaatgtcatggctggatattcatggtggctgtctacataggaggaaggtatgaaaaaaaaaaaaggaaaaagcagaacagaaaaaagatgaagaagaaagaacacccagcaaaagaaaagagaaaaatgcaatcggaagggaagg

SEQ ID NO: 735524 - DNA, 1440 bp, Homo sapiens
gttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcgg

SEQ ID NO: 735525 - DNA, 1225 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagacgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccaacccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctat

SEQ ID NO: 735526 - DNA, 746 bp, Homo sapiens; identical to SEQ ID NO: 73606

SEQ ID NO: 735527 - DNA, 542 bp, Homo sapiens; identical to SEQ ID NO: 73607

SEQ ID NO: 735528 - DNA, 3504 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaag

SEQ ID NO: 735529 - DNA, 355 bp, Homo sapiens; identical to SEQ ID NO: 73612

SEQ ID NO: 735530 - DNA, 438 bp, Homo sapiens; identical to SEQ ID NO: 30973

SEQ ID NO: 735531 - DNA, 942 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtaagctgctgctctgtctctgctctcttcccactaactcctcttttatgttctgctcttgtggaagctgagaaagataagtaggaatgcttattattaggatttaatagaaggtttggttgattctgagtttttatttttaattcaatccttcatagcttctttagctcttagattttgaaggaaatctgttgtgaatagggcttagaagtggccgttgtgctgggctgttgttgtcgacctctgatgaactctgagatg

SEQ ID NO: 735532 - DNA, 4032 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatgtt

SEQ ID NO: 735533 - DNA, 4308 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcgctcttacctacctccgccaagaaaagcttttagaagttgatttcagaattgaccagcagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacttgtaatatatttcaatgttaagtctccacctaagggaagcatgagatgcatgtaacatgcatgtttattcagtatgcatgccatgttcccccttcatgaatatctggacgaaagactgcatagctcctcccgtaacctgttgaatatatacatatatttggccaacctgttcaacaaaacgtatgtctcatccttccctccctcgaagtacccgctgacagaggcttctcacagaagctacacttctcagcctgtcagaatggccacattgtaggctgcgagtctttatagcaaacaaagtctcctttctaaatttgtgatttttaagctgataccatagaattcatctttcaaatcaggacacttttaagagtgaaatgaagtgctaaaaatcctggtatcttttttcaaaaatttactaactgacaaatacatttttattttttgatggatctgccaaataattattttgaaacactatttcaaaaatattttttctagaaagtagaataacatatatctgtgtacaccaaagaaaacttttaaaacttctttacatatataaaaagtagaaattttataataatataatcagaataattacccctttagtcattttttgaaaacacatttgtctcaaataccatgtcattctatttttctaaagaatgttttcttttccttatatggtcttgctatgttaaaattttgaataaaattgtcccaatattttcttcaaaaaaaaaaaaggcctcgttggcatcatgcggtggagctctgcgccaag

SEQ ID NO: 735534 - DNA, 4045 bp, Homo sapiens
agctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcgctcttacctacctccgccaagaaaagcttttagaagttgatttcagaattgaccagcagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacttgtaatatatttcaatgttaagtctccacctaagggaagcatgagatgcatgtaacatgcatgtttattcagtatgcatgccatgttcccccttcatgaatatctggacgaaagactgcatagctcctcccgtaacctgttgaatatatacatatatttggccaacctgttcaacaaaacgtatgtctcatccttccctccctcgaagtacccgctgacagaggcttctcacagaagctacacttctcagcctgtcagaatggccacattgtaggctgcgagtctttatagcaaacaaagtctcctttctaaatttgtgatttttaagctgataccatagaattcatctttcaaatcaggacacttttaagagtgaaatgaagtgctaaaaatcctggtatcttttttcaaaaatttactaactgacaaatacatttttattttttgatggatctgccaaataattattttgaaacactatttcaaaaatattttttctagaaagtagaataacatatatctgtgtacaccaaagaaaacttttaaaacttctttacatatataaaaagtagaaattttataataatataatcagaataattacccctttagtcattttttgaaaacacatttgtctcaaataccatgtcattctatttttctaaagaatgttttcttttccttatatggtcttgctatgttaaaattttgaataaaattgtcccaatattttcttcaaaaaaaaaaaaggcctcgttggcatcatgcggtggagctctgcgccaag

SEQ ID NO: 735535 - DNA, 4658 bp, Homo sapiens
agctgaaaggggccttcaagaagagagttctcagagcagactcagctttaggtgctgaaatgaatttctcaaggccttttacagactccaaatagatggtcctgagctgatactgtcattgtcaccatgatcctggagacacagcctgtagctgtgtggaagtaaacttctaaaacctgtctcttctgagagttactgcatgaaaacaggcaaggatgggtcaagttttggaccagcagcccaagttccaccaaccactctgttatacagaggcttctaagctatgcagagtgctatgaagggtttattcttcttttgcccacctgactgatatactgatgtactttttgaagaagggcaatggaatttacctagacgtcactgtggtcttgatgtggctgaagtgttttgttgaaggctctttagtcctgtactcatttagattgactctcacttctggtccctttttgtggtgcagactaaagcctcaaactctgtaaaagacaatggcttgtctcatgaagagaagtgaccaactgttaataagctttatccaaagagggtcgtggaaaacaagaaaatgcaaaagtgaggttctcttcaatttcatatgcaattaacaaatatccagagctgactgattggtgctcctcttccatgtgacttttggctggctgtatttaaggatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcgctcttacctacctccgccaagaaaagcttttagaagttgatttcagaattgaccagcagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacttgtaatatatttcaatgttaagtctccacctaagggaagcatgagatgcatgtaacatgcatgtttattcagtatgcatgccatgttcccccttcatgaatatctggacgaaagactgcatagctcctcccgtaacctgttgaatatatacatatatttggccaacctgttcaacaaaacgtatgtctcatccttccctccctcgaagtacccgctgacagaggcttctcacagaagctacacttctcagcctgtcagaatggccacattgtaggctgcgagtctttatagcaaacaaagtctcctttctaaatttgtgatttttaagctgataccatagaattcatctttcaaatcaggacacttttaagagtgaaatgaagtgctaaaaatcctggtatcttttttcaaaaatttactaactgacaaatacatttttattttttgatggatctgccaaataattattttgaaacactatttcaaaaatattttttctagaaagtagaataacatatatctgtgtacaccaaagaaaacttttaaaacttctttacatatataaaaagtagaaattttataataatataatcagaataattacccctttagtcattttttgaaaacacatttgtctcaaataccatgtcattctatttttctaaagaatgttttcttttccttatatggtcttgctatgttaaaattttgaataaaattgtcccaatattttcttcaaaaaaaaaaaaggcctcgttggcatcatgcggtggagctctgcgccaag

SEQ ID NO: 735536 - DNA, 1471 bp, Homo sapiens
gggagagggccatctgggaatctgggaattaaggaagtaaggaggtagaattggaatgtttaagccaccaagtaactattagattggtgcctgggttttgggtcatgctctcatgtgcttctgcctgcagcttacttgcctccctcttgggctggttggaaagccgtgggctggttactatgggaattgatgggtgctgctggcagtgagagaaggaaagtacttggaattgatacagaaatactaggagagcaggttttttttttgccctctgctttcctgcttactgttttttgatttgatttaactaatgtggttttagctgaagagagcctttccaagagctcacctgtggtaccctgaggaggagttgagctgtcatcactctaacccaggaagacctcatggagaggagggcaacacaaaggatggctagtttctcagatgaatttctgtttcagcaactggcttctcaggcttcattgaactcaaaattaaacccaagcctctttttatactgttaagaaatgtgctgcagacaggagggggaaagtcagtatttaattctctcttcttcactaccgtcttcttcactaccactcctctccctcttcttcactgccaccaccccttgcaaggaaaaggtaggtggagcattctgtgtttgtcataaatttaatgattctgaaatgttggaaatagaaaacagatgttttaatggggtgatacccacattggaaagcatcaaggtcaaaatatattttatgagtcaactttaatttgattaataacttaaaaccctctaccatagtatatgctactttattttcataactactcatgagtatggaatggaaaacattaatttatctttctaagaaaagtatttggctggaggagaaaagaatattaaagtgtcatggacattataaaatttggtagcacagtcttttttcccctacatttttagtttcagttcactgtttctgttgtttctaaatattttaccactaatgaaaaccttatttaggtaaaacgttttcttttgatttaaaagatttttgttgaattccttgcccagatgtgagagaagtgtctacatctattcaaactttaactttgggtcttagaggtgatgaatcacttggcagaacaaccatgagatgttgaataatctcatgatttggttgacttatttttagaagccactccctattaactcatttaattcctgttatacgggaagagggacagggaaaggattggaagaagaggtcagtcatatacaggccttgccctcctaaagcttctgaacttattttttgtttgttttttgagacagagtcttactgtgttgcctaagctggagtggcgccatctcagcttactgcaacctctgcctcccagctactcaggaggctgagcggggaggatagcttgagcctgggaggtcgaggctgcagtgagctga

SEQ ID NO: 735537 - DNA, 1474 bp, Homo sapiens
atccaggccccacctatgctgcatcctccctcatctttgctccctgtctccctcagaggccaccttcatgtgacctgcctcacagcagatgttcccaaaaggacacgatgccataggcccaatggtttaaaatgtccctggtcctccgtggaacttgctgggtaacgggggaaacgccaaggccccctctcaggagtccattacttgcctgagccccagacttgagtcctattatggttttgaatttgcctccatgcagttcagcatgaccttagaggccctctggttcaacgagtgaggcctgcagcctggacagagagaagagacttccccagggcctcaggatttgaggaaatcacacctgcgtgttggactctaaagctccccatctttccagatacagcataaatcctgacctctgtcttttatcagacatccgaagttcacagcctaagactctagctgggttggaccacacacaagagggcaagacaccaggactgctggctgaggtgcacttcgagggtggtccagagattcctctcaacccccttcacagcccgtcctgaggggtaaattggagtgcagaggtgtgacctgcagccaggcctccagcagccccagctggatcctctgaagtgggtctgggcaaactggccacagcagtttgctccctggggccactatgacacatacacagtacctggctcagcagatgctcagcagatatcactgatggtgaccaggacacaggttcccaccctaattctcatcactgcacccaaactgcaggtctggctgctcttcttgctggctgagcccctgacaggcccagatgctgacctagcagcaagtaggcctggagctcggtgccaatgtccccagcagcctccaatgacaccccaggggaagggaggcggtacatgtgggagggaagggtttggggtctgtttaccttggagctcaatcctctccctccccatggcaggaaaccccaattccccaccctctctgccatgtgccccagggactcattagaaatttggttaacttttttttttttcagcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgtatactttggaactgagttttacggcatgtaagctcagctttagcaaaaaagcctctaatgagaccccatctctgcaaaccataaaaatataaaaactaaaaaaaaa

SEQ ID NO: 735538 - DNA, 1379 bp, Homo sapiens
aaaattacgctagtacgaggctggtgttgaatcggccgaggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735539 - DNA, 476 bp, Homo sapiens
cgtgtggcgacctataggattccaactgccacgacaaggagcggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaaaacccgggtccggggggggggggggggaaaaatccggggaaatcggggggggaccaccgggtttttgggcaacggttcttgggccccaaaaagggcaaggggaaaacgggccgggggaa

SEQ ID NO: 735540 - DNA, 607 bp, Homo sapiens
tgccacctcctatgtgcggaccaccatcaacaagaatgctcgcgccacgctgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacaaaaaaaaaaaagaaaaaaaaaaaaaaaaaaaaaaaaaaaaaaaaaaaaaaaaaaaaaaaaaaacccgggtccggggggggggggggggaaaaatccggggaaatcggggggggaccaccgggtttttgggcaacggttcttgggccccaaaaagggcaaggggaaaacgggccgggggaa

SEQ ID NO: 735541 - DNA, 592 bp, Homo sapiens
  misc_feature (21)..(21): n is a, c, g, or t
  misc_feature (467)..(467): n is a, c, g, or t
  misc_feature (532)..(532): n is a, c, g, or t
  misc_feature (538)..(538): n is a, c, g, or t
  misc_feature (540)..(540): n is a, c, g, or t
  misc_feature (552)..(552): n is a, c, g, or t
  misc_feature (577)..(577): n is a, c, g, or t
  misc_feature (579)..(579): n is a, c, g, or t
tgagccgctctagaggatccncaggactctgaagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaacaaaaaaaactcgtgccgaattcgggagcgttcggagttttttttttttntgttttttacttcaggtttctcttttaataaacaaaaccatccaaggtacagttccaaagttcanaaatcnanccaggtctgganctgattggtggtaagagcacacagntnagtcctttccttt

SEQ ID NO: 735542 - DNA, 908 bp, Homo sapiens
  misc_feature (24)..(24): n is a, c, g, or t
ccacgagctcgtgccgaattcggnacgaccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735543 - DNA, 668 bp, Homo sapiens
  misc_feature (19)..(19): n is a, c, g, or t
  misc_feature (32)..(32): n is a, c, g, or t
  misc_feature (57)..(57): n is a, c, g, or t
ccccggcatgtgctgtagnccagcgagaagtnccacagcgacgatgcggtgcgccgnctgtgggtgtccgtccatgccacggcacacagcgcgatggggtggtcggggatgacatggatgtcggtgatgcgctgttccagcagcaggtcttcggcttcgaagcgtcgggtcatgtagggcgccgtcagggcaaaagaaaaggggcggacccgcacctggcgagccgcccccacgacctgcggcttaacgctgctggcggttgccgccctgctcgcggttcgagccttcgttgccgcggttggcctcttcacgctggcctacagcacatgcctggcgatgccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatgcacgcgacatcgccaggtaccgagctcgattcgtatatgtac

SEQ ID NO: 735544 - DNA, 373 bp, Homo sapiens
  misc_feature (25)..(27): n is a, c, g, or t
gcggccgctactactactaaattcnnnacgtcgacgtcgccgctgcgagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgaatcttgaggtgatcttctgcacgataaggtgatcttctgcacgacgaggtgatcttctgcacgataaggtgatcttctgcacgatgaggtgatcttctgcacgataaggtgatcttctgcacgataaggtgatcttctgcacgat

SEQ ID NO: 735545 - DNA, 749 bp, Homo sapiens
  misc_feature (68)..(68): n is a, c, g, or t
accaccaccacacaacaccgcccccccccccccacgacgaacataggtcagtacaggccttgggtggngcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaaaaacaaaaaaaaaaaaaaaacaaaaaaaaaaaagaaaaaaaaaaaaaaaaaaaaaggggggaaaattatggggggggggggagaaaagagaagaaagagggaggaggggggaaaaaggtttggcgacccacattttgaggcaaaggggggaagagaggggggccata

SEQ ID NO: 735546 - DNA, 784 bp, Homo sapiens
aagacgccccaacagccccacccacaggttcacccaattacggtctaggtacgaggctgggtgttaggcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaaaaacaaaaaaaaaaaaaaaaaaacaaaaaaaagaaagacacggcggaggagcaacacatgtgggcggggcgcgagagaaagagaggtacaatgaaggggcacgagggggaacagagggacaccgcaccccacttcttgtcacacagggggacactacgggggccccccatagggggcagataatcagacaacacgtgtgccgcaatag

SEQ ID NO: 735547 - DNA, 784 bp, Homo sapiens
  misc_feature (9)..(9): n is a, c, g, or t
cggtgacanaactaggctaggtacgaggctgggtggttgcgcgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaagaccggggcgcttcgagagatgcgcgttactcagaagtcgaccgagcgtgctcatccggaagctgccctcccagaggtgggcgagggagatcgcgcggatttccaaaaccgacctgaggttcagagcgcagccatcggtgcgctgcagaggctaacgaagcgacccgggggcctgcccaagatccacccgggtgcaccacgcagagagccccatggccaaaaccagggccccgacagggaaaccaagagggt

SEQ ID NO: 735548 - DNA, 1531 bp, Homo sapiens
ggcggggtaggattacgggtctcggtggtagtcgtgtgcgggggtgaactaagggaagacgtgcgtcgaaggcgggggattggaaacgggcctggtgtatcattggggggcggcgaggttctacatatgaaagtggcagggagttagcgaggggggggggtggttgtaggtgtgtgagcgagataagtggtgatagtaggccccggcgcagagtgagcggggtgatatggtagtggtatatgagaaaaaagaggggggggggggggagaacggaggggtgagaaagaggtaataaaagtggcgcgcggggggggcgcgagaaaaggcggggtgggatgtcgaccagcgtatggtagggattatatggagggggggaggtgggggctattgtgttagtggggggggggggggataagggaggtggaggaggcgatgatgggcgggtaattggggggttgggaggggttttgggcgggggctgacggaacataacgaggggcgacatcgcggcggtggccgtgggatgagtagaggttggagggtgcggttacgagggaatgggcgcgggatgctgcaaacccagggagaaaattttccgtttgaggtgtgacagcaatgtttgaagcgaaaaaaagaaaaggactgtataaatgatgtgcattcaaattatgtgcaccctcaggtcgccgcttgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaatagaataaaagatcatatggatcatttaacttagcataactctatgaccacagaacaatgtaaagcgcccgggctgcaaaagagggcggagaccagatgaggaagtataaatgccatccaggcactatggctggttcatagcaactgcagactgtttttctggaacgggagtggcaatgatccgccggggggccctcccattaaagagggcagtggagataataatttggacagcccggcggttactgtgttattttttgctcgtctaagcaactgccctacgttaaaacgggtcaagcaaggccagaacctacttagtgtagtcggggcagcgtggactcatggagacccaacccccatccccg

SEQ ID NO: 735549 - DNA, 570 bp, Homo sapiens
  misc_feature (40)..(40): n is a, c, g, or t
gtggatcccccgggctgcaggcggcacgaggccgctgcgnagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaatagagaagaatcaacaaaatgggttccctaagaaaatccaaaggaagaaatcctcggaa

SEQ ID NO: 735550 - DNA, 885 bp, Homo sapiens
  misc_feature (571)..(571): n is a, c, g, or t
  misc_feature (595)..(595): n is a, c, g, or t
  misc_feature (597)..(597): n is a, c, g, or t
  misc_feature (609)..(609): n is a, c, g, or t
  misc_feature (611)..(611): n is a, c, g, or t
  misc_feature (618)..(618): n is a, c, g, or t
tcgcatctagaactagtcgggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaagggggggggggcaaaaaaaaacccccgggggggccccaagantatagcgcgagtacaccagatttntnggcacaaagggngncccaaangaggaggcggatataagagaccgcacaggggaaggcagataaaacagagcgcgggcggggaacaaggcgcaaacgaggggaactcattggggacaggggaacacataaaagtgcgagggggcgcaccatacgtggggcacaaataacccgagaagaaattaaaggaccctaggggagaatataaaactttcagggttctctatgggtgttaacagagggcaaatattgagtgtgagaagatgtgcacggcgaagatgtgaaaattat

SEQ ID NO: 735551 - DNA, 193 bp, Homo sapiens
  misc_feature (13)..(13): n is a, c, g, or t
  misc_feature (178)..(178): n is a, c, g, or t
ttcgagctcggtnccccattggataagcggatgagggagccgccgccatgtctgcgcatctgcaatggatggtcgtgcggaactgctccagtttcctgatcaagaggaataagcagacctacagcactgagcccaataacttgaaggcccgcaattcctgctggaaatgctgacgggnaccgagctcgaattc

SEQ ID NO: 735552 - DNA, 4233 bp, Homo sapiens
gctgataccgcccccggaatttagggatcgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735553 - DNA, 578 bp, Homo sapiens
  misc_feature (525)..(525): n is a, c, g, or t
caattagctagtcgaggccgggtgttctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaatccaaaagcaaangaggggggcccggtacccaattcgcctattaggggcggtttacacattactgg

SEQ ID NO: 735554 - DNA, 630 bp, Homo sapiens
  misc_feature (528)..(528): n is a, c, g, or t
aagggaattcgtgctggtgctagggaattcgtgctggtgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaatactaaagnaaacaatttaaatcttgaggcggtgcccagaaccaaataggacctaaggtgagcccgtttacattctccgtagaggggtagatttctatccttggctctttc

SEQ ID NO: 735555 - DNA, 882 bp, Homo sapiens
  misc_feature (9)..(9): n is a, c, g, or t
  misc_feature (629)..(629): n is a, c, g, or t
  misc_feature (632)..(632): n is a, c, g, or t
cggtgacanaactaggctaggtacgaggctgggtggttgcgcgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaaaaacaaaaaaaaaaaaaaaaaaaaaaaaaaaaaaaaaaaaaaaaaaagggggggggggcaaaaaaaaacccccgggggggggnccnacatatagcgaccacacaccttcgtgggagagaagaggccgccacacagcgagggtcatacaacaaaacagcgggcggcgcgccgcaaaaaaacacggcgcggggggcacaaacgtcagcgtggctatctgggagaagacccctgccggcggggagcgacacagcgagacccccccgagcaagagacgcggggcgaaaaactggtccgttggcgcacacccgcagtcggcgcgaacgcgccggttacaaa

SEQ ID NO: 735556 - DNA, 722 bp, Homo sapiens
  misc_feature (501)..(501): n is a, c, g, or t
  misc_feature (505)..(505): n is a, c, g, or t
ggcctgagtggcgatctcagcacgaggccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaanaagnggccgggccgatcagataacgctcctcatattaggcctattaaccaacaattaaccatttaccaatgatgggcgcgatgtaccacgagacagcacataccagggcaccaaacaacaccttgtccaaaagggctcagaacgggataatcctattatacctcaaaaagtttttcctcgcaggatttctgggcctttaaccatccaggctagcctatccc

SEQ ID NO: 735557 - DNA, 847 bp, Homo sapiens
cggacgcgtgggtcgacccacgcgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacaaaaaaaaaaaagaaaaaaaaaaaaaaaaaaaaacccgggggcttttttggggggggggcaaaacagggttaataaaaagcgaccagttggtccctaatgtgtttttcgcgacccgcgtttttcttgtcaacaggcgtgaaatcacaggggccccccaaaaggagagcgcatataaatttcgaaaccgcgcgttacctgtttattgttttcacgcacaacacaaagatggaaagagcacaaacgacactgagaacgggacgataacatgtgtacacaccatggaacacaaccacaccacagaacaatgactcatactcaaccgcacagtaatac

SEQ ID NO: 735558 - DNA, 728 bp, Homo sapiens
  misc_feature (43)..(43): n is a, c, g, or t
gcctactactactactactactactaaattcgcggccgcgtcncaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgcacaataaaaaaaaaaattctccaagggcg

SEQ ID NO: 735559 - DNA, 936 bp, Homo sapiens
aggatccttaattaaattaatcttccccccccccccggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735560 - DNA, 557 bp, Homo sapiens
aggatccttaattaaattaatcttccccccccccccggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaacaaaaactttctcacaaggaggtcggga

SEQ ID NO: 735561 - DNA, 699 bp, Homo sapiens
cggacgcgtgggtcgacccacgcgtctcagggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaaaacccgggtccggggggggggggggggaaaaatccggggaaatcggggggggaccaccgggtttttgggcaacggttcttgggccccaaaaagggcaaggggaaaacgggccgggggaa

SEQ ID NO: 735562 - DNA, 935 bp, Homo sapiens
tctagaggatcccttcggctctaccttgtttcaaggtcgccgctgcagaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735563 - DNA, 770 bp, Homo sapiens
  misc_feature (14)..(15): n is a, c, g, or t
  misc_feature (19)..(19): n is a, c, g, or t
actccagcctgggnnatangaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaagaccggggcgcttcgagagatgcgcgttactcagaagtcgaccgagcgtgctcatccggaagctgccctcccagaggtgggcgagggagatcgcgcggatttccaaaaccgacctgaggttcagagcgcagccatcggtgcgctgcagaggctaacgaagcgacccgggggcctgcccaagatccacccgggtgcaccacgcagagagccccatggccaaaaccagggccccgacagggaaaccaagagggt

SEQ ID NO: 735564 - DNA, 6484 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatgggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735565 - DNA, 6289 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735566 - DNA, 5606 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagtccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttcaaaaaaaa

SEQ ID NO: 735567 - DNA, 3193 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtcccagtcttccccagctcaggggatccgtgtagagtaaccgcgagc

SEQ ID NO: 735568 - DNA, 2696 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaaaaaaaaaaaaaaaaaaaaaaaaaaaaggggggggggttccttttaaagcccccctgagggattcaaattttgaaattggccgtttttttaccccgggaaaaatttttgcccttttttgcttttcccttgggggg

SEQ ID NO: 735569 - DNA, 2668 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttcgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcagcgcaggatggcgctggccctgcgatgctgccatgcgcaggtcgggcggataattgttcttgcggatcatgtgtctgatgctgctgagcgtggcgcgagcattcttg

SEQ ID NO: 735570 - DNA, 4152 bp, Homo sapiens
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaat

SEQ ID NO: 735571 - DNA, 3711 bp, Homo sapiens
gcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaat

SEQ ID NO: 735572 - DNA, 1423 bp, Homo sapiens
taaatggtgttgtagtagcaattctgtgattctgtagttgcaagtacctatttctagtcctaacagtttgaatattttatatagtttatttcacacacactgtctgtatacatatgtatacacatatacatacatctatatattcatgaagatgatgatgacactttgtacaagttcatacattaaatacattgcatgaatgtggtgtaaacaatatgaaaacgtactctactttgcatttatttgaaatataaattttaaaactgacatagtgtcacaagaattagaaaaaaatgtactcttatgactaactgcatttcaagacggtgtggctataaaccctaattgagaatgcagattgatttccacctctctgctgaacatagaggagttcctgatatcagacaccagtacagtatgtgaggaactccctgagactgtgtacagtgcagtaaacagttaccgttgccatcaggggtcaggagaaatccccttccttaaaagtacattgacccagtactatttttatatttgtctatttgtattgcagttggaatttctgacttgaacaggtagaaagatgttatttacttaaatattagatgagaaggttttagagccatatgcctcactgaattggtattatgcttcccttaacactggttggagatactgtagtaatatcacctgtgacttgaaagtccatagtgtgcctttgacaatatgagtattttcagttaggcactgaaatcatttcaagctagagaactgaataccaagctgatagtgcaaatcttctagaagatcctctgcttctgccttgctgaagacagctttttctgagacacagctgccagcaaacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaaaaaaaaaaat

SEQ ID NO: 735573 - DNA, 2194 bp, Homo sapiens
agagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtgggcattcaaaacaaatttattttgggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaaaaaaaaaaat

SEQ ID NO: 735574 - DNA, 675 bp, Homo sapiens
tagaataatatatactttaatgttcaagaagaaactagatgagtagtctatttaatgactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaaaaaaaaaaat

SEQ ID NO: 735575 - DNA, 1430 bp, Homo sapiens
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggctggacttggaatctgtttgaatacgttgtggaataaattccttaatttctaataaatcagtgttatattaattggaa

SEQ ID NO: 735576 - DNA, 1373 bp, Homo sapiens
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagaagatggagtcttgctatgttgcccagctgttcttgaactcctgggctcaagaagtcctcctgccttgacctctcaaagtgctggaattactggaatgaaccactgggcttagccccatttttcacctgtaaccttagtttgtacaattgttgacttttctgttagaaaatagggaaccttcgtatttaaataactttatagcaagtattgaatgtcaaaggttaacttcaaatagcaaatgctttttagtgttcctctacccaatgtaaaacaacaaaattaaccaacttccagagcagtataagaattctaaaagcatcattacaccccctggctttacattttacactccatatactgcaaa

SEQ ID NO: 735577 - DNA, 1141 bp, Homo sapiens
gagacctgtaggaggaacagtgtgtagagtgtggttcaaagagcactgggctgggtggaagagggtgagtttaagtcaggtggccaaacttctgtagcctgaaagcctctctggtctgcgaacttctccgaacctcgtcttctttcttatttcacattttcaagatgaaaatattagaatacattagatcttgttctggtctgaaaaatgcctctatgggtagccaaataactcagttgtcaagaagaaaaacggatatataaattagtctaataagacatgtatttctccaagaattcaagaaatgcaatttgctgccctgctgggctccgccagactccggagaatcattggcgtacaagacaggccttgccttcatggagcttatagccccttgaagtgggccttagataatgtccactgctttttatcatgaagagagaatatagaaatgttttgcaaaaaatttttttaacttcacaaagcttcaaagccacagagtattttcagtatctctagattgtttgtgaagacttatatgaaaaatcagctgttactatgtaaatatgtcagtttctgttaaccagatattgcagtgatgccttaaaggggctggtgcttaagcaaaaatgctttgtagagcagggaagaaggcagcactgtgaataaaagtgtctggtttttgtgtttctagaactgcctgatgctccatggggattcttcatgatgatttttttttgccttagagattatatatgcttatgttaatttatattagatggtatataaggggcttgataataacatgtctggtgcctcaggggctcataaataagaaagtacttaaacacacacaccaaaatttttgagagtgataattttaaaaataaataggaaaaaaagaaaggcttggtaaacactggctacttcggactggtgtcttcattgttgttactcagcagaggtagctgttaaacactgagtgggcatgagcccacaagggctgcggttggagcacatgacagtggttactatacatacgtggatcacttgttatgtaagtgattcatgcactcccagtgcccttggttgggcttattctcaataaaaccagtatcattgttctcctcaaattaaaaaa

SEQ ID NO: 735578 - DNA, 1195 bp, Homo sapiens
gaaccattatgttgagcccaaaatggaagtaataataaatgcctcctggaggctgtgggtgtgggggattctgtatctggattccgtatcactccaagtggaggctgtgggtgtgggggattctgtatctggattcccgtatccactccaggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgcctgctgtgtcctgggttcttgccttgggggactcggggagcgaggaagagagctcttcctcctggataacatcttggattctgtaccattccactgtcccttcccaccagacattttaaatggtcctcgttgtccccttccctgcccttgccttcctgctcattgtgtaggaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagacccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 735579 - DNA, 1894 bp, Homo sapiens
ctgtatctggattccgtatcactccaactggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgcctgctgtgtcctgggttcttgccttgggggactcggggagcgaggaagagagctcttcctcctggataacatcttggattctgtaccattccactgtcccttcccaccagacattttaaatggtcctcgttgtccccttccctgcccttgccttcctgctcattgtgtaggaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagacccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 735580 - DNA, 785 bp, Homo sapiens
gagaagccgtataagtgtgagacgtgcggctcgcgctttgtacaggtacggagccagcctccaagtggcttccaaggcaaacctgcaagaggtggggtgggccaatagggagggttctgttcctcccagaggcaggacttgaagtctcctccctcccaggtggcacatctgcgggcgcacgtgctgatccacaccggggagaagccctacccttgccctacctgcggaacccgcttccgccacctgcagaccctcaagagccacgttcgcatccacaccggagagaagccttaccacgaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagacccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 735581 - DNA, 786 bp, Homo sapiens
cagatggagcacgtggtccaggcatgccaccgcttcatccaggccagctatgaacctctgggcatctccctgcgccccctggaagcagaacccccaacacccccaacggcccctccaccaggtagtcccaggcgctccgaaggacacccagacccacctactgaatctcgaagctgcagtcaaggcccccccagtccagccagccctgaccccaaggcctgcaactggaaaaagtacaagtacatcgtgctaaactctcaggcctcccaagcagggagcctggtcggggagagaagttctggtcaaccttgcccccaagccaggctccccagtggagacgaggcctccagcagcagcagcagcagcagcagcagcagcagtgaagaaggacccattcctggtccccagagcaggctctctccaactgctgccactgtgcagttcaaatgtggggctccagccagtaccccctacctcctcacatcccaggctcaagacacctctggatcaccctctgaacgggctcgtccactaccgggaagtgaatttttcagctgccagaactgtgaggctgtggcagggtgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcg

SEQ ID NO: 735582 - DNA, 200 bp, Homo sapiens
cagatggagcacgtggtccaggcatgccaccgcttcatccaggccagctatgaacctctgggcatctccctgcgccccctgcagaccctcaagagccacgttcgcatccacaccggagagaagccttaccactgcgacccctgtggcctgcatttccggcacaagagtcaactgcggctgcatctgcgccagaaacacgg

SEQ ID NO: 735583 - DNA, 2549 bp, Homo sapiens; identical to SEQ ID NO: 290695

SEQ ID NO: 735584 - DNA, 1853 bp, Homo sapiens
ggcggtaccggccggaggtgtagggatctttgtaaggaaacacaacaacacgttttcttaccttctgtaaattttgtgatagacacatgttatttgtatatatgattgattgtttgcctgttgcaccctaaagttattttcaaaccatgtttattgcaaagagagcctttgggcaagtggaaaatgccctgatgctagaatgaggtagttccataagctagttaggagcttgctacctcttcttggtacctgaaatattctgaaaggatatcggagaggtcctatgcacccctgtctttcaaaacccacctccagcacttcaaagtagtgtctctggagagtttaaaataaaagaatgaatgctattcagtggattccctcattgaggctcccatctttcctgccaggtgcagctttttctggttggaatcatctcttctttacggattgccgcattgtctctttgtgaatgaggcaggctgaactgtagagcatgaaactcattagaagtttataaagtaaagacctgtaaagcatgtgggtggaatgtttccatgctcttgaggtgaatattaaatttaaattctggcctttgggaactctttgcttgtgagctgaagaaggaaagaaggagttgggggtgtatatctaactgtgtttttctatatggaaatatatgagcatcaagtgataacttcaataaggcctcaggattgtatttaaaatacctgttttgtgggacagcatgcctttgttttctttgcctgttggctttggtggctccaaacattttcattttaggctagctttcctgtcacccaggttgtgtgcattttttttttcatttgaactattgtttatcattattaatgatgttatctccaaatcccaaagccaaggaaatagccagtatgcaggacttgcagtagatataagcattggtgttaacataggttaagttttgttagtgttcccagaaatatactgaattgagggataatgtagctttaaagaaattatgtttctttttaacatttggagaagccacctgtcctgggtccctattcttgagaaattcatcttttcatgcaaataacattgatgggggacaagactggatgattgacttctatcagtcagtagacaaggaagtataataattgccaaaggtgagggtaattttgccttacaagtatgtaggtcattctgtggtgggatttcccatcacatctagtaaaaaacaaccttttcatttccctcctttctaatccaagatcatatttttaaaaagtaggtttctgatgtgccatgaaatatttctgtgaatctgtgtttttgaccaaggaaacagctgagatattaaaccatgtggttgttccacggttcatctggctaccgttctgggtcccctctgaccacctcaaaaagaaaatgaaattgggagattaaatcaagcttgacctcctcttttaatgaggaactttcacgttgacttcctatctcaggatattcttcagtttcatactgctgaggagaaaggaacaagctgcagacactgtaactggtctccagatgtgtgtatatgcgtgtaaaacttcacaccgtgtgtgttgtgttcaatgttgtgtcaatctacaaactgactcaaacaacagtttaacgatagagaagacagtgataatggcaaaaaaaacacccaaccacctttttccgtcaaagtgcttgctatggctttcatagctgggacaagtaacattaagtattcaggagcaaagtgttcttgaaagaaaatggtgtgttgatctcataagaaaatgtacaaccaataaaagacattttaaaaagaaaaatga

SEQ ID NO: 735585 - DNA, 580 bp, Homo sapiens
tgaatgtcaaaggtctatgctgaaatttttcagaaaaaacaacattgcatatgggatgtgactcaaaataattgggtaggggaagagcaggtggggttataaatagatttacattcaaaactgtaaattgggtcatgggtatttcagggtcatggccgttctccttctaagtgtgtttgaaaatttccatgaaaaaatggtctttaggtgggtgtgattccctaacatttgtcctacgaggaccaaagacattagaggaaaacaaagacttcttaccagttacagtcaaaaatgtcagcgagatgaggagattgatgccccagttcatgctagaagttaaagccatggctcgtcctctgatcccaccaggaaagatctcgctgagcaccagccagggcactagaagaaaggcaagagtgggtggcggacagcacatttagcaaaaacccattgaatctgagtgccagcaccctgatctctccctgccctcatcctgccgggatttgtggttgggaagcaccatttcctacctcagcagaacaggacagtaaagggacgtgctgcctcctcacctccagcc

SEQ ID NO: 735586 - DNA, 552 bp, Homo sapiens
ttttttttttcattgcggaattattttaatattcacaatatgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735587 - DNA, 7271 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735588 - DNA, 1378 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacaggtattctatgatattgaaaccacacttatcaattatggattgaatgatacaa

SEQ ID NO: 735589 - DNA, 7512 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735590 - DNA, 1928 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagaaggttccggcccgtcgcctttaaggaggggtaattgtgagtccctggtcactggcacgcgcgaggccggccg

SEQ ID NO: 735591 - DNA, 1862 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagattggactcaaaaggaaaactggaccaacaaaagat

SEQ ID NO: 735592 - DNA, 1424 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagctctctgtttctacactttggagcatggatgtctgagaagccacaaagcctattgaacaatctctactaagtatataataaaacatgaatatgtaaaa

SEQ ID NO: 735593 - DNA, 1068 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagttttaattaaccttaaaaaaccttaaattacagctccaatttgctccttaggatttattccctctggacacccagggaaagatg

SEQ ID NO: 735594 - DNA, 7615 bp, Homo sapiens
ggccgttacgcgattttcgctcccgcgggcagcgcctctcaggccactcccgagggaccccgaggacgcactcgggccccagggcgacggttcaaacgggccattgtgcgcccccggggtcccccggcccctgcaggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggagcgaggtttcaccaggctggtctccaactcctgacctcaaatgatccacccatcttggcctcccagagtgctgagattacaggcgtgaggcaccactcctggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735595 - DNA, 6979 bp, Homo sapiens
ctcgcgcactgtctctatgctccccagcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735596 - DNA, 6210 bp, Homo sapiens
aacagaaagccccccccgagccagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735597 - DNA, 6419 bp, Homo sapiens
ccagctgaacgatctctaattctcaccgctacaagtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagagaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacgttgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaattgtcttttctatgcattttttaaaaatggaaaaaaatgctcatttttctcaactattgcggaattattttaatatttcacaatattaacatgaaattcataaaaggatattttgcattaaattatagtttatagttcataaaataagctctataatctttatacttgttgaatgtaactaggaattaccactaaaatcctagccaggaccctctcctaatctagatagaatatatgggcagttgtccacactgtgtgttctggttcttttttgcgtaagatccagtgcaagtagtgtcttggtaggcagaaactgtaccctcatgtccagaccacttgtgtgtctgcataataaagctgcgactggcctccatacatacatagcttaaggcggaggttgatgtcttcactaggacatagtctattcaaaggctgctctgtgaagaaggtagaaagtattaaaccagccagtaactttttttttttaacctgatatcctgctcagaaaaagagatcacttaggaccttgtacctcatctaccttttgaggttccttctggggaggagggggattaaaggctgtctttatcatttcagagtgtctcttcaaaaccagttccatgacactgaaaagagagcacaggagtcgcaactatgcattggtccaaagacaccctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735598 - DNA, 2086 bp, Homo sapiens
tttaatccccctcctccccagaaggaacctcaaaaggtagatgaagtacaacctcctaagtgttctggcactatccacgttcagaaggtgttgaggccattaggtctctggagaaagctgcctggattggcccctaccacacagcttgttacactccaagagctgctcctggggttttcttttttgaggctgttttggcactaattcttcttggtgatgactcataaaacaaatgttgtttttcacatagttcacttttgctagctccattgatatttgttccaaagagcatccctttgtctcaggtataaacataacaacaaaaagcagggatgctagactcatgattgtatatataaagcacacccatggcaggccaataagatcagttacagtcaaaaatgtcagcgagatgaggagattgatgccccagttcatgctagaagttaaagccatggctcgtcctctgatcccaccaggaaagatctcgctgagcaccagccagggcattggtcctagaccaattgaaaaagcagcaacataaacaagcaagctggctaaggacagccatttcaaaaaagctgggacgtccccagggtctgtgactatctggtattcagtgtggcttaatccagcatttagcaaggatgctgaggtcgtctcccctctcttatccacatcatttctcaggggcatgagtgagcttctgctatgggaagaaatccctttgaagtggtctctgagagtattgttgttggttgacaggtttcctggtccataaatcacagactcatccaaggactggttgatagaattgtggcttctgcagatatgggtgaagttcatgtggatgttgagatttacgatgcccatggtcaccaacgaagctgccatcacagaggagccaatgcagaggaatgttttgctgccgacatggtctacaagaagagtggcagggatggtgctaatgaccttgacgactccaaccccagtggaggcgaggctagctgcctcattgctttgaaatccaactgacttcaaaacagttgatgcatagaacaatatgtttggttggccagtgatttgtacaaaaaatactagtgttagtcctatcattattcgggtccgcatgttgtcttttgaacgaaacagatcccaaaaactgtactgatattcatctttcagggaggatttgatcacagtgagttcctcagttgtatctgagagtgctcttaaccttccaagaaccttgctagcagctccctcttgtcctttcatcaccagaaaccgagggcttggaggaagaaaatacattgcaattgcttgcaaaactcccaagggaatcacaagaccaaacatgtacttccagccatggaaaacattggcaaatgcgtaatttgaaatataggcagaaagaatgccgatgacaatcatcagctcattcagtgacacaagaaggcctcttctgtgttgaggagcaatctctgcgatgtaaacacaagtggcaatggaagagagggagatggagacccctatggcaatgcgtcccactataagaaccgtgtaggataaactgaggatcaagactaagcttccgagtccaagcaggcaggatgacaagatgattgctgtccttcttccatatctgtctatcaggacccctccggtgagtgaggcaaggagggctccaatgacgagggagctcacaaccatttcctgctcatggcagctcagggctaataaggttttgatctgaagaagagccccagagatgatcccaagttcataacccaccaggaggccactgacagcagcagtgacagatgacaggaaggtaaacatgccgcagcctctcgcccagggaggatgccggctgccgctgccctccgtctccacggctgtccccttctggttcagcagactggggccctcggtgttttcaacaggtaccatggtcacgtagaagttacagccgcttccccgccaccaaaccgccccgaccacccccgctcccaggagtggtcactttccccataatagcatgctaaagaagagtgtggggaaaaacttcgggcaaagctaatgt

SEQ ID NO: 735599 - DNA, 1056 bp, Homo sapiens
caatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgcactatgcagctgctaacggtagctaccagtgtgcagtaacattggtgactgctggggcaggtgtcaacgaggccgactgtaaaggctgctctcccctccactacgctgccgcttctgacacttacaggagagcggaaccccatacaccttccagccatgatgccgaagaggacgagccactgaaggagtcccgcaggaaggaggccttcttctgtctggagttcttactggataacggtgcagacccctccctgcgggacaggcagggctacacagctgtgcactatgcagccgcctatggcaacagacagaacctcgaactgctcttagaaatgtcctttaactgcctggaggatgtggagagcaccattccagtcagccctttgcacttagctgcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctgctgcctctggccacactgactccctgcacttgctgatcgacagtggggaacgagctgacatcacagatgtcatggatgcctatggacagaccccactgatgctggccatcatgaatggccatgtggactgtgtacatctgctgctagagaaaggatccacagctgatgctgctgacctccggggccgcactgccctccaccgcggggcagtgactggctgtgaggactgcctggctgccctgctggaccacgacgcatttgtgctgtgccgagactttaagggccgcacgcc

SEQ ID NO: 735600 - DNA, 958 bp, Homo sapiens
ctgttttacagcaaacttaaaaaaaaaaaaagtagaggtacactctaaaataacaataaaaaatatagtaaatgcataaaccagtaacagagttgtttattatcgttatattgtacataattatacgtgtgatacttttacatgactgacagcataggtttgttcacaccagcaacaccacaaacatgtgagtaatgccttgtgctacaatgttaccatggctataattgatgtagggatttttcagctccattataatcttatggaatgcatatatggcctgtcattgaccaaaatgtcattatgtggcgcatgactgtatttttaatgtacaattaaaataatagtaaatttttcataacatacctgattgtctcctgataagaaaggaaagaaatctaatcctgtggaagaaaaaattatttcagtttaaaaaaaaaagaaggaaaaactcttccaaatgccccaatacttcaaaaacaaatacaagtcttatatgctatgtcactcagaattttatttaaacatgaagagttgagctaaacgttttacgtctctcctttctttagattactaaggctgaaaactaagctttggcaatgatttgtcttctccgtgaccccatttgggggactggggccattactactctgtcagatctaacactgatccttaaacgggcatagtacttttaacaaatgctctggactcctcttaaggaaactttcaatctgctctaagttactcctcacaagcacttcatgaggtatgtaattagttttgccctcattttgcaggtgagaaagtttgaagttgaaagagttaggttaagtaagttgtagtactgatttttctttcttaaatttgctcatttgctatcagattcaactgacagactgcagtggcatgaggggagaagaggtttgagtgcctgcaaactggctactattacataaga

SEQ ID NO: 735601 - DNA, 658 bp, Homo sapiens
gatccacctccgcccacgctggctcctctctcaaccactcccgacacctcgcctttctgctctctctcttctctctgtctttgcctggtcctttgcgtgggtggtgggggtggggctagggtgggtgggtgtggtgggggggtgggtggtgtggggtttttcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttccccacgcgtccgcggacgcgtggg

SEQ ID NO: 735602 - DNA, 2095 bp, Homo sapiens
acagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggacagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaaaaaaaaaaaagaaaacatcgaaggcaccaactacaagaaagcggagagacaagaagggcactcgacagtgtgccacatgggcaaaaagaaggatacacatgaacacaaatatctgtggtcccagggggagtaaatcttgcagaaacccccaaatagaagagagcagaaataaaatcgagatacccaaggttaccctgtagagacacatacaaaagaaat

SEQ ID NO: 735603 - DNA, 696 bp, Homo sapiens
gaatttcagacaaacaacaaatacttttccaatagaagtatatgtcctatgcaaaatttggggcatacaataaaagtatattcagtgtttatctgaattcggtttaacttggcagtcctgtattttcatttgctgtatctagcacccttgggaggggagagagggatggagggagtaggcaaaaggaaggggaaaagagggagaagagactaaggatggggagggcggcatgggcggagagtgaccagacgctgctgaccctccctctgggctgtgtgcagagtacaaggaatgcttctccctgtatgacaagcagcagagggggaagataaaagccaccgacctcatggtggccatgaggtgcctgggggccagcccgacgccaggggaggtgcagcggcacctgcagacccacgggataggtgagtggtggtgggaacaacggggagaggggaggggcccagcaggtgggtgcagacagtagaggtgtgaaaagctcagcagtttgaggggcaggtggcagggaggcctcctggggatccagctgtggcagccccagaccaggagtgccgtacctcacttgggcttcctggaatcctcatagcaaccagtgataccccatctcacagacctcgggatctaggcgttccaacagacttaccaaacccagagaaaaatcgcgctgacagcgatccc

SEQ ID NO: 735604 - DNA, 2447 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735605 - DNA, 348 bp, Homo sapiens
gcctactctactattcgggtgcgagaagaggacagaagggaagggacccacaggaagtcacagtggtgcccagggatgtgtcagcccccagccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735606 - DNA, 1153 bp, Homo sapiens
ggacgcgtgggtcgacccacgcgtccgggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735607 - DNA, 404 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctgggattgcctctggaggggggggcactgagcagggggagggggg

SEQ ID NO: 735608 - DNA, 220 bp, Homo sapiens
tgctagacagcggtgtaataggacaggctctcggaaggtaaggggcctgcggggcagccatggaggcgacgcggaggcggcagcacctgggagcgacgggcggcccaggcgcgcagctgggcgcctccttcctgcaggccagaacggaaatgggggggggtggtgggagggggttggtgtgtgaatggtgaggggagggagggtggtgtgggtggagggg

SEQ ID NO: 735609 - DNA, 708 bp, Homo sapiens
ctgttactatcaaatgaaaatttcattatgaataataaactgggtcaaagtaaaagcctaaaacgaaaattcatcctgcaaaagtaaccaaatactatcatacaataatcttacctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735610 - DNA, 644 bp, Homo sapiens
taccataggcttatagactcacatgaacacagctgagattttgttgaaaaaacttcgccccaaaatccagtacaacactaaagctaccatacccaactccaaatcctatgtccccaaagctaatgtcactgctgctaactgtacatagttggtacaagtgtttcacccagtcaatgaatatatatccaaaataaaaatgttttcttaaggaaaaactatgatttaacaacagttgtgatgacttatttgatagttatgttggcaatgaattttaaaaaacagctcttaggacttactggaaggctgcaaggttttgtattcactttcacacaaagattgggtgggaagtgatcttcttgtggacaactggtttctgataaacaaaacctaaacaataaaggacaagttaaatttcctttattaaaggatgacttcattagtattattgttaaatagataaatttaaaagatggtaaatttaaaaacaaccaaaagggaaaactataaaaactggacctttcaccctattaataagtatatgtaaataggtttaaaataaataattctgtcaatgtagagttggtaatcatgactatcaccctgtagttgtcttcgtgatactgccaattatttggttaagcatg

SEQ ID NO: 735611 - DNA, 1763 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgatcctctttgtaattactatttgtacttgttaattactataacttttcaattcttttaatattcatgattt

SEQ ID NO: 735612 - DNA, 1916 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtgccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735613 - DNA, 2513 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtgtactgacctactttgggaccacaggcccatctagtgcaaagtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735614 - DNA, 2419 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgtgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaaaaaaaaaagaagaaaaggaacacaaacaacgcacggcaaaccagaaaggagacacacgcgggggcaataataggggggggggagaaaaaaaaggaggaaacaggcgcgcgacggacaaagagtgtcgcgcccccgaacttggagcaacaggggggtaagcgcgggggccccaaaggggaggggaaactagagagcggcggacccgaa

SEQ ID NO: 735615 - DNA, 3933 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735616 - DNA, 4136 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgcttgaaacttgctgcaaattcttcaggtgatggggtgctgggggaagccgttcatggtcaggtgccttgccagtggcacaccacttagagaagatgctgagggaagcttctgtcagctgggcactgaaggttaccatgcactgccagaactgggagctggagaagctgccctttcaatttctgctggatggcatagcgcgccttccgctcctggtcgagttcgttacacagggtatctggaagacaaggggaggggccagtgaggaaacgcagaccaccctccgaaaggccggggtcacagcccgggcttcctcctctccccagggctaagctccgcgcagaaacaactcca

SEQ ID NO: 735617 - DNA, 3982 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatggttgtttgaaaatgactcctataatcttcgtgtattcagataatttctgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735618 - DNA, 3826 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735619 - DNA, 2850 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagatagcgtagctgtagtagctacttctctgctgattg

SEQ ID NO: 735620 - DNA, 2323 bp, Homo sapiens
  misc_feature (2292)..(2292): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgcnacacccaggcctcgctacctagccgtaaggt

SEQ ID NO: 735621 - DNA, 3869 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgactgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735622 - DNA, 4012 bp, Homo sapiens
  misc_feature (2014)..(2014): n is a, c, g, or t
  misc_feature (2022)..(2022): n is a, c, g, or t
  misc_feature (2025)..(2025): n is a, c, g, or t
  misc_feature (2032)..(2032): n is a, c, g, or t
  misc_feature (2039)..(2039): n is a, c, g, or t
  misc_feature (2054)..(2054): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttgggggggtttnttgggggnccnaaaaganaaagganaaaaaaggggttttnaaaacccccctttttggggggggcccccccccccccccccccctttttttcgactactgactcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735623 - DNA, 1720 bp, Homo sapiens
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagaggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttagggaaaaaattaaaagaaatgtacagagaacaaaactatattttcagttttacttttgtatataaatctaagactgcctgtgtgataaaacacttgttta

SEQ ID NO: 735624 - DNA, 4022 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatcctgtggaagaaaaaattatttcagtttaaaaaaaaaagaaggaaaaactcttccaaatgccccaatacttcaaaaacaaatacaagtcttatatgctatgtcactcagaattttatttaaacatgaagagttgagctaaacgttttacgtctctcctttctttagattactaaggctgaaaactaagctttggcaatgatttgtcttctccgtgaccccatttgggggactggggccattactactctgtcagatctaacactgatccttaaacgggcatagtacttttaacaaatgctctggactcctcttaaggaaactttcaatctgctctaagttactcctcacaagcacttcatgaggtatgtaattagttttgccctcattttgcaggtgagaaagtttgaagttgaaagagttaggttaagtaagttgtagtactgatttttctttcttaaatttgctcatttgctatcagattcaactgacagactgcagtggcatgaggggagaagaggtttgagtgcctgcaaactggctactattacataaga

SEQ ID NO: 735625 - DNA, 3927 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatcctatatgggaatgattaaaatacaaggcaagggaagagctatgacatctctcttttctcagtgtcactacagtttatcagttacagtttagattcacaatattgttggagccagagagtagaaaaccaacagtgg

SEQ ID NO: 735626 - DNA, 4354 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagctttaaaaagggagaaaaagtaaatattagataattgctattcaacatttaagctttgacaaaaatttcctagaacacaacaggtaggcatgctgatttaaagcatacagtgttgacttttcatcaatgtagaagaacattaaacacatttcctgtgaaatatccataggttaaaaaatgacagtatttctttggctatcaaacaaaatgactatggaaagtctacaacaagggttatttactaaaatccacagctcacagatcagcttt

SEQ ID NO: 735627 - DNA, 5517 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgcttagagaaaaaacaaaatgtaaaacattagtattccaataatataatttacactattaaatgacactttattataacccccttcttatggtttacttaagcaaataaaggccagctcacttataatcctattatttcaaacttcaaatttaatcatttaacgttaagtaaccaaagaaatttaaaattaatattcataaattcattgacttctacccttggttataagaaatataggataaagtatacaccagggaaaaccacacctcactttattccactgttttgatgaaactgtcaggtatttatcaagcacttactgagtctccaggagaatgtcgagtgctatgtagatggcaaaacgtaatgatgtgctctcaagaatattttgttttcttggggaagaattataagtatatatgaaacaacaaacagtccatctcaaacac

SEQ ID NO: 735628 - DNA, 5217 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctttagttccgcactgtccgccatcttgcgtctgtcagcgcaagcgcagtgaacttcgccgggggccgccgctagacccgcccctctagccggcctggccccgccccggcccgcccctccaccttcccagcccgcctctggcctccgcc

SEQ ID NO: 735629 - DNA, 5375 bp, Homo sapiens
  misc_feature (1229)..(1230): n is a, c, g, or t
tagtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaatccacnnttttttttttttttttttttttttttttttttttttttttttttttttttttttttttttttttaggatgggttgtttataaatacatatatacacacacacatatacatatcaacaccaacttttttttttcccaaaattcaagtcaacaatttagtggcagagagatgctataaaaacattatttttagatgccacacaagtcatgagaaccattaattttatcatacaactgaagtacagccatcttgaattctacctggattaaagttgatcattttgttaccaatgcaaggtttaaaactacaagtgtatacacaaaggtggtcctcatcaactctgagaacattaatagttgcggtaggaaaatccagtctggaaaaccagcagtcattatgccccttatctcttctgttaaacctgcattctcaatcaactaaaaaatattttccacacctgagaacatcataccttctctgatgaggattttggaacattagtagaaccacttttccttccctccaactcatatttctctcctgaaaaacagttttcagtatatttacatgttccattatgaataagagtagatcagactgatccatgaattctaaaaaaaaatgactttcctatgtcatacttgttaaaaggtgaagaaaaagataaacaaggcagatacgctaagaaaataggtatactcagaaccaaagagtaaaaatgactaagggtcaaacacatcttgaatttcaactgtttatcaaatagtagacttctacaaaaatgtggtgcattgtactttccaaacaatttatttttaggataactgaccgtgtatctttcttttttaggtgatgtaacattacctctgtcagctgcacaaaacacctgacagagctttctaagctatttttacttcctactttggtatgaagatcttacatgaaaacttgttactctgtggccaaaaaaagcaggtattcacagacttggtttaaatacacaatactggcaatccagatttagaataaagaactagactaaagtgtattattcataggtcggctaagcctactccttacccagacagctttattccaatatctctaaaacatattctcagggggtacagagcaaataagagaatatgtgatggagaacatgcaattgggatagttgataaagatgctcacacgtgagttcaagaccttcaaagcactttgaaagaagcaagcaactgattatattaactgaatgcacactcgggaggagagggaacagtgatgacagaaaaatacatacagacgcacacaatgaacacacacacccacgagccatgtcctgaaaatacacagggaatgcagcgggacagatgagctttataacttaaggctggataaaatatgcacacacaaacagaatccaagtctgtcgttttcagaaaatggaaatcaaactatcccccgaccccctccccacaacaaagaaaagcccacgattgaaaacttcatacatgcaattccttttctgttattgcaaataaaataatgccatcgaagtcaaataaaaccaaaaccataggacaaataatgaaaaatcttcagaatccagaaaaaaatgaactgaaggtggtttgtgggtgcttgtttttcttttttcttttctttcctttttttttttaaacaagtgttttatcacacaggcagtcttagatttatatacaaaagtaaaactgaaaatatagttttgttctctgtacatttcttttaattttttccctaaaaaaaggaaaaaaaacacgcttgtatacttttctaaacagagtaaggtaaaacagagcacaaagttctcttctttctgccaagttcattcgatctggggtggggatgggagcagcagggcctgggaatcagtccaatgaaataatgtctggtatgatgccaaagatggatgccgtgtccgtgctgctcctgtttgtgacggtgtggctatggctttcccttaggctgttggaagaaaccaggctgctgttactgccactactgcttccattggtggttggcagagaagtactgcctcctgcacttaactgatcaagaaacatctgtgaggaggtatacgggaaaaaccgagacgagtgtaggaggtcttgatcatctgaaactgctgctgctgcagcggcaagcaaggaggtgttgtaatgctgattgtctcctgataagaaaggaaagaaatctaatccttgtaagtcgtaaggcatgggtgtcatgtggaaaggatgcctatagtcttggatgagggaggtattaatgtagcttgtgtctacagcaggaaggcttggggtgcgggatactggagatgcttgatgtggaagacttaaaatgcctttattatttagtggtgatgtgggagatagggaaggacaggtcctcttggcagatggctcttcttcctcttcatcagatgaactgtctatggttaggtcaatcacttctactttcttgtttttatttgaggactggtggtgagacgctacctgatgctccaatgtggagctcaagcatccatcgactccattgtaagaggcagaaacttcctgtacttccttttttgatctcatcggtgcccaagtgccatcctccttaaattgtatttcatcacagtctgtacagtactttaggatttccataaacaagccatcaataataaggtgttcatatggagccttcttatcacagacaggacaaacccaggttggttttttctcattcatctgaatgtaaagagttgcgtcaaaacattgtagatgagaacatgtaagggcccgacacggaattgtcagccgcattttaccaagtggacatagtagagaaacccttaggctggttgtagctatttcactgtctggatccgcagtcaacttctctttaattaaagctctagaatgatccggattccttattccctttgctcgtaacctctgaagaagaactgttgaggacaactgttttacaagatatactgccatggaatagtttcttccaatttctgcagtccaagaaacaacaatcgtgtttggtactgttgtggacagtcggacaagtgaggtgatattaattggtcggctgggtcgctttggttccacgccattttttgtaggtggaaggtaacctggaaggctgcaaggttttgtattcactttcacacaaagattgggtgggaagtgatcttcttgtggacaactggtttctgataaacaaaaccttaactggacctgtactgtgaagtcacatttggtcccagaaatatccatggaactactgatttgctgcacttgttgtggtgtcaaggcaaatgcaaaacaggtttctcgaaagcgctgactgttgtctgatgctagactggtgggttttatcagttcatccagtaaatcataaaatggtaatttttgaagttttatatccggatggactgggtgaagagctgatgtaagatgtgggagttccagttcatgtttaggtcccagaagagaaacagggagtaatggcgatgatgcagggtgaccatcgtaagtgagttgtggaatggtagatggagacaaagttgctggcataggacttgaatgtacgttggggatggacaagtctgcaggcgtcatgattttctgtgggaaccgccgcctatagagttccttaattttcatttgcacagcaggactacagccagcctttagcaaatgcagggcttttgtgagaagttcgtgtttgcgtccgtgcttgtttctcccggcgtagcccaacagtacttggagttcagaaactctaaggctcataaccatttgctgggagagagacgagaaggagctggatgttggagagtatggttggatgtcggagagagagactcatcctaaatgtaggcatatagtttttatcatcctctgaagagaggagtctggcagggatggctggagaatctcaggtgaagattaccttcttgttccgtcccctttccagctccctttctcactgagagccactttcattggcaatgaaatcccccacatttaccaccttcaattcgtttgtgagaccttattcctcctggactccagacaaaaactagtgtgcctcaagtgtgggcacaaa

SEQ ID NO: 735630 - DNA, 988 bp, Homo sapiens
  misc_feature (477)..(477): n is a, c, g, or t
ctatcatagtgacactattgattaaatacaccttcagtttcttaaatgttaaggagactgcaaaatatgaaaaaaaacaatagaatagcctttaatgggaccatgtgagtacaagcatcttccatttaacctaactaccaccattttcttttgatataattatcaaacttttcacgcaatcattttctgcactgccagaggaagctccctttcaataaaaaagatatgaggagatgcttttccaactcgtacaacccctgatatgaatcttacaggcagaccaggctggccaacaaagtcaactcccatcctgacagaccaagagttcaaatactttaatactgtggtaaccccgaccttttacattattctaagatgccttctgttaaagcttagaacaactccctagggagcagtgccacaggaatttctgtagttcatggaaaaatctgaaaagcacagatacaatttctttgnaacccaatctccaaaaatgggagatttgaagtgaagggaagatttgtgttagaaatgaaggcagctttcccatcacataaatgaaagcaaagaacaaaggtcaagggtcaccaccccatttcactgaatctaaagtcctcaataccaaacatatgaccaaattcagtcttccaaattgttacaatttagctggctatctttactgcgtaaatttgaatatactgtttaaatcatagatttcatttacaaaatcaaactaccaagacacaggatacactaaggtgtatatattgcataattaagtagtaaaacatcccaagggctccaaccacaattagatttttaccgtaaggattgaatgcatggtaatcagagagatcatctgtgactctgcaatgagaaggatttacacaatttccaaattctgaaaaccaggttattgcaatgcctctgaaatacagttctaggaaaagctgtcgttaagtaagattaaaaataaatgttaaaaaaa

SEQ ID NO: 735631 - DNA, 2189 bp, Homo sapiens
ttcgggaatcgtcgaccacgcgtctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735632 - DNA, 1646 bp, Homo sapiens
aattcaagcttctaacgatgtacggggagctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735633 - DNA, 1684 bp, Homo sapiens
  misc_feature (4)..(4): n is a, c, g, or t
  misc_feature (46)..(46): n is a, c, g, or t
atancctaggagttagaatgtgaccagacaatagatggtcttaaanataccaataagattaggcctgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735634 - DNA, 1663 bp, Homo sapiens
atccccacctgtgtgctcctgtgtgctctcccccctgtgtgctctgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735635 - DNA, 962 bp, Homo sapiens
gcctggctaatttctttatttttatttttttgtagagatggggtcttgctatattgcccagggtgtcctcaaactcctggcctcaagcaattttcccgcctcagcctcccaaaatgctggatgacagctgcaagccaccacaagcaactctgtcataatgcagtctttataaccagctgagcacaatctctactctcaaaatagggctctgaagtctaggaacaagtcctcagctcctgaaatgacagaggaggaagtgagtgaagtgaatgaatgaaggacacagtcaatattgagaataatcacagtgattgcaactgtaaaccctccctgacgcggccttgctctgaatgctactctgttggtctttcaggatggtatcagcactcccagcagacagagtggctcagggctcacaccaggtccctcagcccacacccatcagacttggggttcaaactcagatctgtctgttttcaagacagagcccaaccagcctgcctgaaatcagccagtgaagacttaattgagggattgctaggagacagatggtctcactgggtagatcataatcaggcaatgccagagggaggatccccactggccaccccattcctactgtgtctgaggacacatggacgaagcctcagctcagggcttcgtgttagggtcctggatttggggtgggggggcaggatgtgccttgtcggggctccctgctcaccacgccatggctcagccttgtcgctgctggtgggccgcctctgctccttttctcttcactccctctcttcttccagtgatgctttgttcttttccctttgacgtttccagaagatgcagatgcctccagctattacgagtcccatggcaacaaggatcagaggcagagctgctttccatgccgtgaactgggagcttctggagaaggtagctggagaagattcccagaagccaggaat

SEQ ID NO: 735636 - DNA, 4944 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcaggtgcgggagccccgctgggtctgcccaccatcgggccagggtggacgcaggcagcagcgagccattgggggaccattgcccgaagtcaaggcttaaaagcccagcctgactcccactgccgtggccttgcagggctgaatttcgggaatgggtgggtggtcagggaaggtgatgggaaggggttttaagttgaggagggtctgaggtgtccctgaccttcacaaaggagggcacttggcatcccgagtgcccgagcatggaaggctcctgcctcgccctggggtcctgaaggcagaagcagccaagaaacccaacctcagggcttttcttctgcctctgcccagggcctggcctgaaccccagaccctgcagcaacccagatggccctgaacggttcagttgcccgtgccagccataggtgacaaggctttggccctggggagacggaagtctgggccaggccctgggtttgttgtgctcaggacagtacctcatgcgctgtctcatgtgcgctctctctttcgctctctccttttgcctctgtctctgactctgtgtgtctctttctctttttgtctctctgtctttccctctcccctcccatgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735637 - DNA, 4336 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735638 - DNA, 2897 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactgggggaccagaactgggatcctctagaacgcgcagacagactgcgtatt

SEQ ID NO: 735639 - DNA, 3130 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagaaatacaccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgataaagacttcagatagtgtagcggatgaccaggttactctag

SEQ ID NO: 735640 - DNA, 2836 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccagcatccaatccacacccagcagacccttcggcatgccgccctctaccaggaagccagaggcctaggagctcgccatccatatttatttgaaaaggtcaaaaggagcatctatgagacaagggaggggtgcaggctgaagcagcgcctcaacagccagggacatgtaggcaacacgagcaggcacagcgcggccaccactgtccacacgctcacacaagccaggcccgcagggccttcggagagctagcaggttacattca

SEQ ID NO: 735641 - DNA, 3115 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcacgagggcgtgggcacacaccaaggtagcgtgtgaccggcgaggagcagtcactgtgctccacctggcagagacagagggaagccatttaacacatgagtccccggggcatgaggcggctgggagggggctaaacacacatgaggatatacaggagctgaacagggtggcagataagggctgggagtcactagaatagagaacgtgcaagcacaaagagcaccatcagggacgtgaaatctggccaagctggtagccaggagactccgctgctgagcatcgtggctgtagcatcgagtcgtggaaggaactcagacagggacagactgcaaggttggggacaatatcgcgaaagacgtgaactgggggtagggcatggcgcgtgcaattccacggaccatcaggcataagaccgggcatggcgacgcacagggccaactagcggacgcgacagggtggcaaacaacagaacaaacaacaacagaaaagaacaaggagacaagaacgaacacaaagcgaccagagaaagaggagcaagccaccggccgcccctttcccccca

SEQ ID NO: 735642 - DNA, 2577 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgtgtaccccgccaccgtttcaatctcgcgtcgttttacaatccgcaaccgtatcactcccgctcgtaca

SEQ ID NO: 735643 - DNA, 4085 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735644 - DNA, 3904 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggactgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735645 - DNA, 2086 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagaagatgcagatgcctccagctattacgagtcccatggcaacaaggatcagaggcagagctgctttccatgccgtgaactgggagcttctggagaaggtagctggagaagattcccagaagccaggaat

SEQ ID NO: 735646 - DNA, 1462 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactcccctcccccgctatgtgaggatgtgccctgtgcgcttcagccctgaggagatggtgcctgtcctgtgcccatatagcatgaactgtggctgagtgtgcaatgtgtatgccggttatgaggccaagtgac

SEQ ID NO: 735647 - DNA, 4059 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735648 - DNA, 4313 bp, Homo sapiens
ggccgggtgtagtggctcacgcctgtaatcccagcactttgggaggcagaggcgggtggattacgagtcaggagttcgagccacctgccaacatggtgaaaccccgtctgtactaaaataccaaaattagccggcgtcgtggcaggcgcctgcaataccggctactcggggggctgaggcaggagaatcgcttgaacccgggacgcggaggttgcagtgagccgagatcgcgccactgcactcaagcctgcctggcaacagagcgaggctgtctcaaaaaagaaagaaaagcaaagcaaagctaacaaatgctcttctgtcatgcatcatcacagaatcaatgagagctccccccagccaggagacagcggacaaccagggtagcttcccagggggccagagggaggctgcgcgagaagaggctcagcgggatgggtccacgcagggagatcccacgcagggtgggcgtatacgagtgtccacgtccggagggccgttcaagggcgggtccctgaaggaagggtgcacgcagggcacgtccacgcgggcaggcccgtgcacgcagggcgtgcccatgcagggcgggtccgtgcaggatgagagcagcggaggaggcccacgcaggccatttcccgccccgtccccagcccacgcgggcgagctaccgcgggggtacgcgcagctcagatcctagcagcttacaaaaacaaccttttaaaaatggaaccttcaagtaaaaataaaactttgtttccctctttcgcaggagttactgaagtaggaagggacagcccagtaagatttcaggatacgacttgggccggtccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcaggggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtgtgatgttttgatatctatgtacattgtggagtgacagattaatgtatccatctcatgttttttttggtggtgagaatatttgaaatctacactcagcaatttcaaatacagtcatccctctgtgcctaagggggattggttccaggaccccctcatggataccaaaatctgcagatactcaagtaccctgcagtcagccctccctctgcacatatgtgggacagtcagatacagagggccaactgcgtacagtacacggttatcagctgaagtcaccatgctgtgcaatagaccttgagtttattcttgtatagcagggactctgtaccctctgactagaatttccccaaatcctcttgtctcagcccctgctaaccaccgttctactctctaattctataaatcaacattttgattccacatataagtgagatcatgtgatatttgtcctgttcctggcttatttcacttaatataaatgtcctgtaaattc

SEQ ID NO: 735649 - DNA, 2409 bp, Homo sapiens
ttattcaataaaattaatccccccatataatgcacagtattgccacaaatgcccacttcatttgtctgcatagacatattaagaatttttcaatgatgtaatttaattatcctaaaagaaatgacagattcttctgtaggaaaaaataaaaacatgaatatctcaaattataatggttaatctctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccatttttatcataaacatttcaacataaccaacattagaacaagtctgccatgttaaaaataatttaaagacttatctctgaaaacggtatccagaaacgcaggtgttcccagtaatgtagcttcaaaaataaaatgtgctatttatatgacatgaaattcataacttttggaagggtatatttatgacagcataaaaaataaattctgtgctataaagaagatccaacaaattaaccatataagcacagaaaatagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttatctgttggacattactgaattgtctattcatttagtacaatttcttaaccttgaaaacagacattgaaagatggaactttcttttttccagtgacaggtccattaaatcgatggtacaaaacatacttctttatgccaaacacattatttttgaatacctttttttcaacttcatacattatccatccattttagttttcctcgatgatgcccattttctttgtaaatttctaagtggaagttttaaaaattaagcatcagtaaaataaatgttatcttatttgtacaacatttaatcgttattccttggaatatatgaaccttgtaaagtgatgactaagggtcaaaaaaaatgttgctgacttagggaaatttgcttgagaatgccaaaattttaaaactctgtaaaggtaattttacattcacttatgtgtgtttactaatgttgagtaggaacagaagcaaaaatacctaaacctattttttttaaccttcacactctaaccagtattatatatttcagctacctaagataatgcaattaatcatatatccaacctaagcttctgccaataaggatttcagataagcttttaaatttatggaggattttctttgtgtctttggaagttcacttaccataaagtattttatagtctactttaaataacagattttgttacacagggtaagccaaaggctgtacaagatttagtgtcattgggtctcatatttgtgttagaccatgaaatattccattaaaatttatctgtaaataca

SEQ ID NO: 735650 - DNA, 1626 bp, Homo sapiens
  misc_feature (671)..(671): n is a, c, g, or t
ttttgctctcatccctggaggtgtaacagccttttcccattcagtactttatttttccagatagttcatatggagtagaaggaacatactatatctgtttctgtactgatggatcgtgttcagttgtgtacatttatctctgaggcctgctaatgccatctgagtttctaaaatccttatttttgcaaatccatttgtgtcctggggtttagctcctgattttaggattagcacagattacagggtctgtctgatgccttctccaagctttgtatcagatttatgggctatggaattgaggaagcttgcacataggataggcgtggaaactagaggcagatacgagctgatgggagaaaaaagcaaaaggagctcttgtaaagaattggagtagttatcaggccagatatttggatcagaaccagttaagaacctgaaaacgccaactttctgtttcttgacttcacaactgtgctgggctgcctgttccctcttttccagaacagttttccatggaccctggctgtgcctcctccccaccccacccagtggctgcccccagaatagagttctaagccatgctccagccctctgggtggcatcctttgctaagagggctctctcctgtcatcagcagtccctatggcctccatcctgtcagttcttattanacagctcttctgctctacatcaaggagcctgagagactggaataaaggacagagatgggtttggggcacagagcaacccatgccactcctaccctgtgatgcagaaatattagggggattcagccacctaatattttctggaagtggaaaaagacatatgtaactgtggtaaagactcatgggtcactttaggctatatgtgttttatgctgcagcactagaacataggagcagcttaaataatcagatttatcatctcacataaaatgtcagtccctaagtaggacagctccaggggaggggtggttggtttaactaagatatgtccccaggtcagaatcaggcaccttggttttttccctctttctatgctgccattctctccccatgaccacaagtacctttcttggctgcaagatgattgccatagctctaggcattgcatgctcatacaccaatcgacaaaggcaggagaagcatagtttcttgttttgtgcctttttaaaagtttaaaaagaaaaaaatccttccccacaagcatctcagctgacttccttttacaactgattatccagatctggatgacacatccactcctaaaccactatgtgaaaccaggaaagggaactcttttcctccaccccaatgattggctgagactagggatttggaggagccatgaatttggatacagaaaatttttctccctgaagccagggtcttgctctatcaaacaggctgaagtgcagtggcacaatcatggctcactggagcctcaaactcctgagctaaagcaatcctcccaacctcagcctcctgcctagctgggactatagatgggtgccactatgccaggctaattgtttttattttttgtagagatgggatcctgctatgttgcccatgctgggttttttggggttttttgtttttttgggttttttttttggttgtt

SEQ ID NO: 735651 - DNA, 1815 bp, Homo sapiens
gcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcagattggtaca

SEQ ID NO: 735652 - DNA, 629 bp, Homo sapiens
ctcctttaaggatctttccaaaggtcttcaattttgatataagcaacaaagaataagagggctattagaccagaaatattccatgaagaagggagcaaagattcatgtcactgacaactggagaagaaacagagaaagggtactcatgatgtgtgacaaatggcatgcctcctgcaagagttatgagttatgtgcctaaacaggaaggatcatctcattgcagaattagggcatcatccagtgggaagggagtttcaaggtcatttagtccagcctccgagtgatacagaaattctctttgcagcatccctatcacgtggccatcaaacttctactagtgtattcatccacacctggtctgtctaaaaccttgagaacagccccttgtatagttcaatagccccagctgaaggaaaagtttttgttattttcagtaaacatattctgttgtgtaactttggttgatcggttcccctttagcgacccagaaaacactgagctccctctgacacccatgccctttgactgaaagtcagccataaaatagagcaccagagtaactttccagagtcccagatttgccccttcgctccactgcaaatcaaatgtgtgacctgtgtttcaattca

SEQ ID NO: 735653 - DNA, 569 bp, Homo sapiens
ggctcactcagaggctattgccaggagcccttgttccttaccacaggaacctccccagagggtttactgtcctcaagacatggcaaccagcttcttctggagcaaatgatctattcctacctgccctctggcttcattcatggtcatagggcctcagtttttggacagagagcaccaccatttttggccatgcattctctttttccacagcccgtttatatccatctggtcaccaccatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggaatccaggattcaaccccctaaaacttgctgttttctttgtcctctttgctgtgaaccaagacacttgttctgtagcagagtgtttctgctgcaaatccagtggctactgcattatgcaatgaagt

SEQ ID NO: 735654 - DNA, 649 bp, Homo sapiens
cattagttcatgtcacatgacttcacctccagatagaccttgttctagcttggaatccatctgaagtgcattctaaactaggggaagcgtccatactttcttagctggagtatcctttggggtttttccatcctccaagctattttttcttgctaactctgccatctattcatggatgttgtgttgttgtctgtctgggtgatttacacagtgctggtcatgctgccagctctagcgtcatcttccctttgaagcacagccagaaggatgtcactggaaatgctgaattactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggaatccaggattcaaccccctaaaacttgctgttttctttgtcctctttgctgtgaaccaagacacttgttctgtagcagagtgtttctgctgcaaatccagtggctactgcattatgcaatgaagt

SEQ ID NO: 735655 - DNA, 268 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggacccacaccaggcgccttgtgtgcgaggccgagcggcggccgc

SEQ ID NO: 735656 - DNA, 1268 bp, Homo sapiens; identical to SEQ ID NO: 277175

SEQ ID NO: 735657 - DNA, 792 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggaccccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctgtatcctttctttaattttattttttaacttctactttgttctccccagtccttctgtgttgctgatta

SEQ ID NO: 735658 - DNA, 795 bp, Homo sapiens
agtctcaccatgcgctgcagatgttcacacactttggacaaggcgcgttcccagtgctctgcagccacatgtggccccacactgactgctccaggtgctatccacttgctctcctgctgactggtagtgcacttactgggtataagagaaaacagttccagatactccagcatgtcgtttgtttattcatttaaagatcagatatgtgtttgcaaaatttatcatatgtaattaaattgtgagtgatcattagtggcatttatctatttggagcatgtaagttgacatctttttccagactcataaataccatgcttaaagtccgaatcctgtcaatgagccagtgttcagttcaatatgcgttcagcatatatttaagtatctactgtatgtcaaagttagaataaacgtgtttactctgttgattaaaatatttcagttatttactagacttctatattttaggtactatattgaggttaaaaggtgcaatcttgagaatggcatttctggataccacaggctgcttaataccacctgcgtatgaaccctggagagagcacaatgttccttacaattccataggttagaaatcaacacaggtcttatgggtgttcccatggctgtgtttcttgttggaagtttcaggagagaatccatttccttgccttttttagcttctagaggccatccgcattccttggtttctggtcccattgtcagtattcaaggccaacaaccttgcatatctctatttttctgaagccacatctgtctgcccacagctggaaaaaa

SEQ ID NO: 735659 - DNA, 439 bp, Homo sapiens
catatttagaagaaccaaaagaatctatagctaaattgttagaaataacaggttaccaaactcactagatgtaatcatatacaaaaataaaatttaatttatattaacagtaataaaaaatgaaaaactttaaattactatttgtgtagttttctgttgctgctataacaaattaccacaaaattactagcttaaaagaacccaaatttattaccttacaattccataggttagaaatcaacacaggtcttatgggtgttcccatggctgtgtttcttgttggaagtttcaggagagaatccatttccttgccttttttagcttctagaggccatccgcattccttggtttctggtcccattgtcagtattcaaggccaacaaccttgcatatctctatttttctgaagccacatctgtctgcccacagctggaaaaaa

SEQ ID NO: 735660 - DNA, 468 bp, Homo sapiens
tctagagcatccccacgttgacacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagtgtcaacgtggggatactctagagcgag

SEQ ID NO: 735661 - DNA, 8522 bp, Homo sapiens
ggctcactcagaggctattgccaggagcccttgttccttaccacaggaacctccccagagggtttactgtcctcaagacatggcaaccagcttcttctggagcaaatgatctattcctacctgccctctggcttcattcatggtcatagggcctcagtttttggacagagagcaccaccatttttggccatgcattctctttttccacagcccgtttatatccatctggtcaccacctcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctgtgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctgaaactaaacaa

SEQ ID NO: 735662 - DNA, 623 bp, Homo sapiens
ctcctttaaggatctttccaaaggtcttcaattttgatataagcaacaaagaataagagggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacacatataaaaggccgtagtaggcctttattagtaattattttccccatctttataagattttagagtttgaaagcattttccccaaatcgatgccaaaacttggacccatgctggctccttgttagctatgggaaagtcattgtatctttttaaacttttatatctttctctttgtacagtgacttaagacttctatcttctttgcaaatcaaatgtaatgataaaggtgcaggaaagctgaatatttaatgcaggtattttatttgaaaccaagtgctcctgttctccagggtctactttctgccaccagcctacatcccattgaatatgtttcaatcaatcttgatgttgggaattctttcatgtttggacc

SEQ ID NO: 735663 - DNA, 1605 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaaggtagaattttttgtaaaaaattatatattaaatgcacaaattttagtatttttcaataaacatgctatttcaggatcacactta

SEQ ID NO: 735664 - DNA, 7604 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctgtgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtgtaagtatattacaatttaattaagtacaatagtttaaagaacgaagcaattttttttttttgggcttagaacttcttaattgtaggttcctctgaagcgatttcatgtagatatgtgagtgttttaaacaagtctgaaagtgttacatacttttaggttacaggggtgctggggagacagctgaggaaaggaagaatatgtggaagacaccacggagttcaaagttttaccctgagttctatcttccatgtatgttttgcttaaggcatttctcatgtgacattagaaaagctatatccaaaggtaaattttttgtggcaaagatttattttacactttaacttttgggattttatttgtttcagcaaaataaagagcactga

SEQ ID NO: 735665 - DNA, 8635 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctgtgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctgaaactaaacaa

SEQ ID NO: 735666 - DNA, 3403 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaagggtatagtatcttgattttaaagtattttcttttatgtttaatttatttagtttactttgactagattttgacattttatatcaaaatattgttttcagtgaagaccaaaagcagaaagttttccaagatggtagccaatgatataggtaggaaatagaaatttctattttgtttctaatccttgctatatgcagtgctaacccaacaccagaattatccagtgcattgcatttttgtgtaaatttgttgttcctatgctaaaaaaataatctcttgggctgtgtctcttctaaactcattggggca

SEQ ID NO: 735667 - DNA, 2097 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctcctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggtttgttgagatccaacagatatattccaacaatagctatattccaacaatagattaaatgaactctaagaggtgtatcatctgtttgactcttgcatccttcattgtgtgacctgtagcatagttatctgacttctttgtggttcattttcctcacttatgacatagatggataaaatgtcagacattagttgtttaattgagatgataatgtatgtaaaacatttcaagcagtttctggtatataataaactctataaatgattgagaagccatttttttaaggaa

SEQ ID NO: 735668 - DNA, 942 bp, Homo sapiens
tttgatctatgaaccattttatttcaaatacatcttactgttacaatttggcctactgcttggtggggaaaggcctttccacgtttcactcactgcagagcaatccagctttcctgtgatattcatctgatgtttatatccatcttttgaaatataggggctattagaccagaaatattccatgaagaagggagcaaagattcatgtcactgacaacttctgaaagggcagtctaatgacaaagtcagtcgataattgctcagaagatctgtattcaccagaaagagtctttctgctgatattcagaagatcaaattttaagctcagcatgaaccaagatccagttacactcagtatctcttcttttgtgggtctcatttcaataatgttccagacctgattcagtcagtctcaaataccctttggaataatagtcttctgttctctagcagtgacatttctccagcaacagtggcatattcagaagaaccagaaaagttcatttggcaccaacatttcacatgaggtacttcgagtagtcaaattcatagagacggaaagtagaatggtgtttgccaggggcatatatatttttaattatctgtatatgtatacaatctgtttcctcacataaattgtaagctcctgggtggcagctatgtaaccttgggcaagtgatttaatttctttgagtccaaagttttgcatcatataaggcctcagataactttctccttcagacagaacatgtgggagaataagatccctgtggcaaaatcccattctttgtccttagcgccagatgccatcacttcttggaaatgtcatcattgcatatttctatttgttttcttggtcgttgcacccagcgaatcaactaattcaataaatattaaacgacaaatcaaaattttgtaggttccaaatgcaagacatcgtcct

SEQ ID NO: 735669 - DNA, 7863 bp, Homo sapiens
agaaccaccactacacataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctgtgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctgaaactaaacaa

SEQ ID NO: 735670 - DNA, 3331 bp, Homo sapiens
gtaagaaagagtgcctctgacagagttcactgagaacttcaatgtctttttttgacattgagttatctctgtggcttctgtcatttattagctcagaccacagcattaattactgatttttttaatcttaaatgacaagacactgctgtcctgggaccttgctttaggtttagttatggctttttcctcagcctatgtggcccacctttctaattttttttcctctcttttgacctccccagaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgcctttgtgagtatcaatttacccagctgatgatgtgctgtaagactgtgctgtctgcaaagccaaagccatcctttaacagggctgtgatgtagctgagatccatgcacaggaaaggactgcctgaggtgaagttttccaagttatcacacacttccctggcttttctttcaaaatcttcaacttttaaaataccccccttttcataatcaatcatgtctgtgtcaacagctcggtcataatagtaagagaaagcatagaaggaacctctctggacctcctctggctggtgaagttttcctcgtaccaccctcagcacttcggcatagcagggctcaaagcccacctccccttcttggttgccaccatactggtatttcacacccccaaagatccactctgcttccaaccatctcggtaaacaggcactccggaaagtgtgcccatcagtcccttctgtctccagggctcccagggttgctagtcttgcagctttcaatccaaatcccaggtaactatgtgtatagagcttataagtgctgttaaacatctcaaaggaagtgaggtagcccctaggagtttgttccagagttttctcaaactggggcaggaacgtgatttgggtggaggctccccctaggtccaaggtccccacagtctcctgtctgtggccatgcagctgacctgtcagaaaattcacagtaacccaagctaatatgccttcgtcggatccatccatgatgctaacactgccctttggtaccaggaaaggtgacttcctgaagatctcctttacctcaaagagcagagccttggctttgtgttctggcagtaagcgtagtcctgctgttgcctttaggaccactggggtctttttccagtgacttcgggggattgagtctttggccacctctaagagcccttgaacggtctcagcaccctgcttaggttgatctacaaaagcagaaagtcctggcttcacagaatcaaaaacttccccttctagaattggaagctgtcctggcattttctgcacaaaggtgtaaacatgaattcgagttccagtgctccctgcatcaaacataattccatacaaggtgctggcgctgacattgatggggcacatggaagacaggaagataccctcaaaccaagtctgctggttcctgtgggagacagcgctgcaaacacaggataccaccagcatgaaaaagactgtgccccaagaagtggccattcttttcccaagatgtggctgggtggaggcttttgttgcagaagcaatcctgctcgcacacctgcagaggctgtagtctcagctactcgggagggtgaggcaggaggatcgcttgagcccaggagtttgaagctgccgtgagctgtgattgcaccactgtactccagcctcggtgacagagtgagaccaattttttctttccttctgaattttctccttggttcctttattatatcactttttcaaccttacatctggatacaagtcctacctaacagcaccataatgatcttgtctgtatgaggattcagccaagacactccacatttctttgttgaccaggaacaaggaaaacgcgcgcgcgccacccttgcgcggcaggacgcgtgggtcgacgcctatctttgtacttccgggccggtccccccctctttcttcctcctggttgtttttccttttcttgtccttcctgggggctgggc

SEQ ID NO: 735671 - DNA, 2657 bp, Homo sapiens
atgttggtccactgtactgatgtgggctgagagagccaaccaaatccaagtggggttttgtcaggaacggtattggaaactctgaactagataaataattcaaaggatattagctaaagtgatcagggaccaggacaggaaggtactgttacaaacggagagaataaaagggcaaactgaaataatagatcctggaatagcacagacactgacctctgaccacagaccaaaagttagggcctagttgtatttcttagaaatacaaagaaaacaagtttagaatcatagaaaacactgttaacacattagcctgggaggtggtactggcactgaatatacacatacccataaagtcggatatgttcattaatcccagagttgactgataaaatgctgattaaagcaaaggtaggctatatgaggcagccacaccctcccaaaacatgtccccagagaccgggtggccttctttcttaaggctgtaatttatgcacagttaggagttactctctcatcctattaatatttaggatggctctcagctggctgattggagctaacacagaataggatcatacagattctgacatggtcccattttgcgttgttgaattatacatggaaagcaaaaccaggtttttttttttctctctttttcaggggaggtgggtgcagataagggtgggcagggcactgtatagggaggaaaaaaatactgatattgatgggtcttgggattgcaataagtcagtttaccatttaagaggaaaatttaaatattcagtggaatgaggcactcaaagggttgaaatgcgatttttctttggtttccagggacctgtccctgggctctcactccaaggttaagttccaaaactatactttttggctcacagggctctctgtgatgctctggtgccagctgtgtactcttgagtggttaggcagcagttcacattagatgtgtaaaattaattaaacctaaatctctaggctcaagtccaggatgtccccagactagttcagaaactaagtgctctctcctccccttaaaaaggtgttggcaaatgcaggtctccaaggaagtacgtggcctcaatgggagatgcccagagactgcaacaggtgaaaggtggcccccaaggcccagcccgtctctatgttgttcactttctttgtgagctgtaagactgtgctgtctgcaaagccaaagccatcctttaacagggctgtgatgtagctgagatccatgcacaggaaaggactgcctgaggtgaagttttccaagttatcacacacttccctggcttttctttcaaaatcttcaacttttaaaataccccccttttcataatcaatcatgtctgtgtcaacagctcggtcataatagtaagagaaagcatagaaggaacctctctggacctcctctggctggtgaagttttcctcgtaccaccctcagcacttcggcatagcagggctcaaagcccacctccccttcttggttgccaccatactggtatttcacacccccaaagatccactctgcttccaaccatctcggtaaacaggcactccggaaagtgtgcccatcagtcccttctgtctccagggctcccagggttgctagtcttgcagctttcaatccaaatcccaggtaactatgtgtatagagcttataagtgctgttaaacatctcaaaggaagtgaggtagcccctaggagtttgttccagagttttctcaaactggggcaggaacgtgatttgggtggaggctccccctaggtccaaggtccccacagtctcctgtctgtggccatgcagctgacctgtcagaaaattcacagtaacccaagctaatatgccttcgtcggatccatccatgatgctaacactgccctttggtaccaggaaaggtgacttcctgaagatctcctttacctcaaagagcagagccttggctttgtgttctggcagtaagcgtagtcctgctgttgcctttaggaccactggggtctttttccagtgacttcgggggattgagtctttggccacctctaagagcccttgaacggtctcagcaccctgcttaggttgatctacaaaagcagaaagtcctggcttcacagaatcaaaaacttccccttctagaattggaagctgtcctggcattttctgcacaaaggtgtaaacatgaattcgagttccagtgctccctgcatcaaacataattccatacaaggtgctggcgctgacattgatggggcacatggaagacaggaagataccctcaaaccaagtctgctggttcctgtgggagacagcgctgcaaacacaggataccaccagcatgaaaaagactgtgccccaagaagtggccattcttttcccaagatgtggctgggtggaggcttttgttgcagaagcaatcctgctcgcacacctgcagaggcaattttttctttccttctgaattttctccttggttcctttattatatcactttttcaaccttacatctggatacaagtcctacctaacagcaccataatgatcttgtctgtatgaggattcagccaagacactccacatttctttgttgaccaggaacaaggaaaacgccccggcgccctccttgccgaaatttcctggggcct

SEQ ID NO: 735672 - DNA, 408 bp, Homo sapiens
tttttcctctctaaattccatgtctagagcacatgttcccttctccctgtcttctatttcctgctatctcattccttctgtttattcctggccccagttcctttagttagatctttcactgatcctgcccctctccccctggaacgcatatcaacacctctcccaccttcgtcggatccatccatgatgctaacactgccctttggtaccaggaaaggtgacttcctgaagatctcctttacctagagaaaaaggaaaaaaaaaaaaaaagaattccctaaggcaataaaatagatttccatattttgacagtgtcctgtaagacttagaaaactactccatttttcctagataaaattttggcaaaactcattcctttgccctaagaaactagagaagaaactaggc

SEQ ID NO: 735673 - DNA, 932 bp, Homo sapiens
  misc_feature (1)..(1): n is a, c, g, or t
  misc_feature (21)..(22): n is a, c, g, or t
nggttaaatgcatcttcccgnnacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 735674 - DNA, 443 bp, Homo sapiens; identical to SEQ ID NO: 367399

SEQ ID NO: 735675 - DNA, 777 bp, Homo sapiens
ccttctccaggctactagtggccggaaaccgggccgcggaggcacgatgagagccgtgagagccctagcacgacttgcccaaagacaatttctcaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaagctgccaaacttttctgaagaggctatacaatttcactttcccaccagtctataagggttccagtttctccacatcctcaccaacgcttattttccttctgtaaaaaaaaactgtagccatcctgttgagagtgaagttgtatctcattgtagtagtggttgcatttccttaataactaatgatgctgagtatcttttcatgtccttactggccatttgtgtatccactttggagaaatgtctgttcaaaatattttgcctgtttttaaattggattatttgtttttgagttataggagttctttatatattttaaatataaatttatcagttatgcggcttgcaaatatcttaatgttct

SEQ ID NO: 735676 - DNA, 1279 bp, Homo sapiens
ataaatctggaaagtcggattgtcactctgtttttgttttttttgtcctgttggtttctccctctctctttctaagctacctgaaatcctcatttttcattgtaaaaaagtaaccatttaggccgggcgtggtggctcatgcctataatcccagcactttgggaggccgaggtgggtggatcacttaaggtcaggagtttgagaccagcctggctggtgaaaccctctctactaaaaatgcaaaagttaaccaggtgtggtggcacagaaaaaataaccgcagcctgagatacaaccataggtaaaaaggtaatggcaaaaactgcaatagcttttgcaccaacctaatacaaaagttaaggagagggagctctctccaggaaaaataaaatgtagatcctattcttgagttagtattcattgtatagctatatttttcaaggagaaagtactgatttctggcctcaaaaaggactaaattctgtgatgtccaaatgttgaatggttggttattcaccaaccattactgccaagtgacagagaattctgttcctcacgttttggctgactgcctttggaacataaagccatctctctgttcttctgtgagacaaagtttttatttgtgtaatgagaatgctgtctgttgctataaggatgttagcttccaagagatgttgggtgctgtgtatcaaaatggtgggctcctagagataggtgctacataaagctgtggtattttccctttactagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtattctttccttttttttgggctctgcttatgccttcaaaagccatatcttctggagaaaagaaagggctctctaggaaacacttgctcctctctggtatagaaatttcacccaagttacacaggccaggccctcttctctgaaaaacttaacaggtgaggtcagcatgcatttattcagtgcctactgtgtgcctggcaccatgggaaagacaaaagtagaagatagggaccttaaaatccagttgagaagtgaaagcttacatatatatgggaaagaacattgagtacataaaagatagtatat

SEQ ID NO: 735677 - DNA, 713 bp, Homo sapiens; identical to SEQ ID NO: 384366

SEQ ID NO: 735678 - DNA, 912 bp, Homo sapiens
agaggggttagaaaaatgttggatgatgagtgctagaggggctctgtagactagccttgtaagtttgttggaggtgagaaaattcctggcacacaacagctttttagaatttgttgattgaaccaattagaatgaataaaaggattgctaagtaacagtgaatgaggacatagctgagagtaagtagcataactttttttagtagacctgttcagattttattacttttctctgctactgcttaacagtttaaaagctgggtactggagaaaataggtgatggaggttaatcagagcagaggcttgctgaggaagagatgaactcaaggaggagagggattctagaatggaatcaggtcattgttgaatgactggccgtgggaaacaaggggaagccagaacatgacaagtggagaggaggaactggaaagttacttatgaggaaagcaagctactgcagcaggagcaaggaagttggagagttataaacaatcagggatgtacatttcagagttgagatcttagaagtagagcagttttttaatatgatgacaagttctaagcagaggtggcaaactggtatcctgtaggctagatgtggacttcagatgtgttttgcttggattgtagagcgtttttattttactttactgtgtcagattatgtgaaagattcaccaaagtagagaaatttttttttatatagcaacagtggtgttatacctgtcaaaattaatatttccttggttttatcttataaccaatccatgttcagttttttctacttgtttcgaaaatgtcttttaaagttggtttgtttaaatcaggatccaacaagatccaatattatatttggttattaagtctttaaaaatctagatctttctacattgagttgttgttgttgttgttg

SEQ ID NO: 735679 - DNA, 1274 bp, Homo sapiens
  misc_feature (1207)..(1207): n is a, c, g, or t
  misc_feature (1247)..(1247): n is a, c, g, or t
  misc_feature (1254)..(1254): n is a, c, g, or t
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatgganaaatgtcaccttggtctgggatggcatcaaaaaatctggnccttctnagtggaaaaaactcagtgtc

SEQ ID NO: 735680 - DNA, 1327 bp, Homo sapiens
tgtaaaatccatggaacatctttagtacattgtaggtgctcaacaaatactaataattctggagtagacacagcctttggataatatgggtaccagtattacttttggagcctaaatgacactcaaagcctgctaccttcacaccaaagactccactgctctgtagtagcaacaagaataaagggaactgaacatactgaaatggattccgagataaatggtgaacactaccctactctgggccatttagtatatattcctggcacaggtctaggtcctctgcatatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaaaaaaaaaaaaaaaaaaaaaaaaaagggggggggggctaagaaatttccccgggggggcccaattttggcggtcacccccgctttctttgggctcccacggggtccccctatggggagcgcgtatataaataacgcattggccacaggcgccgcgggtttcaaaccccgctcgttggccgggcggaaaacccggctccccctggcactcctcggggaagggacccttaactctgtgggcgttggcgccatctgtggcaccacctcccctcagagaatctatcgcgccgagggcaaatataccctctcacccgctcttcaccgggtacccaccgcccattatgtcttggcgcttgaaactttgggcacgcgcctctattctcacactcttc

SEQ ID NO: 735681 - DNA, 2032 bp, Homo sapiens; identical to SEQ ID NO: 384377

SEQ ID NO: 735682 - DNA, 3570 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgagaaaatggcaataaaaacagatacttttgaatttttccacaaagatagtttttttaaaaaagcttgagaaaggtgctttagttagagcaggcactcttgctatcaatcatcctgtctccacagctactgagaaaatatccactcatcatcattatgatttgagatggggtcttgctctgtcacccaggctggagtgcagtagtgtaatcatagctcaatgtaaccttgaactcctaggctcaaggcatcctcccacctcagcctcctgaatagctaggactataggcatgtaccaccagtccagctaactttttgtggtttttttggtagaaatgaggtctgtgttgcccaggctggtcttgaacgcctggcttcaagcgatcctcctgccttggcccctcaaagtgctgggattacaagcatgaaccactgcaccgagccagaatatccaattattattggtgagaagaaaattattccaaagttcacc

SEQ ID NO: 735683 - DNA, 7891 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagtaagaggttgctcagaggaatgactttgcaaacagctcttaatttcttttgcttttttttgaaacagaaggttgcagtgagccgagatctcaccactgcactccagcctgggtgacagagcaagactctgtctca

SEQ ID NO: 735684 - DNA, 10233 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttactttttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 735685 - DNA, 7818 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagcctgtaagactgtgctgtctgcaaagccaaagccatcctttaacagggctgtgatgtagctgagatccatgcacaggaaaggactgcctgaggtgaagttttccaagttatcacacacttccctggcttttctttcaaaatcttcaacttttaaaataccccccttttcataatcaatcatgtctgtgtcaacagctcggtcataatagtaagagaaagcatagaaggaacctctctggacctcctctggctggtgaagttttcctcgtaccaccctcagcacttcggcatagcagggctcaaagcccacctcccctgccaggcaaaggtgcacaggggtaaggtgagaacgacgctgggggaaggggacactctctgaggcaggctgctggagacaatgagggaacagcaggaagg

SEQ ID NO: 735686 - DNA, 8805 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagcctgtaagactgtgctgtctgcaaagccaaagccatcctttaacagggctgtgatgtagctgagatccatgcacaggaaaggactgcctgaggtgaagttttccaagttatcacacacttccctggcttttctttcaaaatcttcaacttttaaaataccccccttttcataatcaatcatgtctgtgtcaacagctcggtcataatagtaagagaaagcatagaaggaacctctctggacctcctctggctggtgaagttttcctcgtaccaccctcagcacttcggcatagcagggctcaaagcccacctccccttcttggttgccaccatactggtatttcacacccccaaagatccactctgcttccaaccatctcggtaaacaggcactccggaaagtgtgcccatcagtcccttctgtctccagggctcccagggttgctagtcttgcagctttcaatccaaatcccaggtaactatgtgtatagagcttataagtgctgttaaacatctcaaaggaagtgaggtagcccctaggagtttgttccagagttttctcaaactggggcaggaacgtgatttgggtggaggctccccctaggtccaaggtccccacagtctcctgtctgtggccatgcagctgacctgtcagaaaattcacagtaacccaagctaatatgccttcgtcggatccatccatgatgctaacactgccctttggtaccaggaaaggtgacttcctgaagatctcctttacctcaaagagcagagccttggctttgtgttctggcagtaagcgtagtcctgctgttgcctttaggaccactggggtctttttccagtgacttcgggggattgagtctttggccacctctaagagcccttgaacggtctcagcaccctgcttaggttgatctacaaaagcagaaagtcctggcttcacagaatcaaaaacttccccttctagaattggaagctgtcctggcattttctgcacaaaggtgtaaacatgaattcgagttccagtgctccctgcatcaaacataattccatacaaggtgctggcgctgacattgatggggcacatggaagacaggaagataccctcaaaccaagtctgctggttcctgtgggagacagcgctgcaaacacaggataccaccagcatgaaaaagactgtgccccaagaagtggccattcttttcccaagatgtggctgggtggaggcttttgttgcagaagcaatcctgctcgcacacctgcagaggctgcttgtgtctgccggttccctgagtccttgctttcgctgcaggttgccttttgctctttgctcctgtttcagctcttcttaatcaagcgagcctcatgaaccgcattcacctttgtgccagtttgcaacta

SEQ ID NO: 735687 - DNA, 9988 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttactttttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 735688 - DNA, 9937 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttactttttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 735689 - DNA, 9068 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttactttttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagatgcattctaactccacgaacttacctattttgttaaccttgattggttacttctcccagaaggtctaatcaag

SEQ ID NO: 735690 - DNA, 8042 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttatacaaaatttgttttcttagagattaagaatttaatctttccctttaaaatagtgtattgatttacccttaggattccataccagtaaaactgaaccgaggagtcttaggaaacaacaagaacatcttcatttcttaagcccaggtgatagttactctgtcaccaccaaaaaagacgcatctgggaaaatccttgattttggtctctttctcttgaacagcccgggtgccttgacccttgtttctcacaaagtcttcctccagcccagcctgcttcagggtgtctagataccactgttctgcttctttcttggctagatccttggcaacttgttcaaagagatagggccttgtttgtattcgctgcttcatttcctccagttctttcttatattctttcgctcttttacggtcattgttccggttctctttcagctttgctttgaacacttcctccaggcttttatggggatccatggcttttgcacgcaaggtcacagatttggacattgcttgagacttctttttgtgtatctccagccactgaatactctcatctgctttgttctttttttcaagtgcacttctgactgcagattccctcttcctggtggcatctgtgatgtgcacagggagagtgttggcagagagggaagcaaggccgctcagagaacgactccttggcaggggtgtagctggtggctgtggggaatcctgcctccttccggtggtggcagcatcacagggccgctgagggtggcgcaggttggcggtcctcagcaagaagggcttgttgcgagtggcctcttgggtttctcttcttttggctgctcttctctggaaggccttgtaaaggccctcatagtcagggaccacaggattcacccgaggctggaatctgaagttagtgtgcagaaacccaagcttttcctgctgggttcgggtggctgtgcggggctgtgggttagcccggttactagaggaggcgataggggaagaggccatctggagcatgtccagggctctcatttggatgcgaattttcctgaagagctcagcttcctggagtttatccccaagggctggctccagaatggacttgggaatccttctggtggccttctgcttggagatcttggcttcagctgtggctgccaagtctctctgtcgagcagcttcctttagctgctcctccttctccaggaagctgaagggcttcaaagaagagaggagcagttccttcctcttctggatccctgcctgccttcgggcctcgctgcgctccatgatctcttggtagaggggcaggtagacatgtgcaggcacaggctgtgcccggaactgcctgtggcactcggcctcttcctcaccctgcctctgggcccgctgcctctcctgctcaaaggaggcaggtgagcccagccactcggccttcttccgggcctcgcgcagcgtcatgcggaatggccgagggacagtaatggatgatgcccaggagctgacgcttctgtgctgggagggaggccgggagcctgagggtggctgggtctgaggcctgggaatgttggagggaaggttgttcagggagctgcagcgccttgtggagccacacctcagagcctgcgggcactggacctgcaccatccccctgtccttgtcttggaagaaactctccaggtcctcctcatcttcagagaggttttcatcactctctgggtcagactgaaagagagactccaacagacaccatctccctttctgcttcagttcctgtaagttctggtaaatgctcccagttgagtcagaagtagaatctatctcctcctctgggctgaggaactcgtcaagtttgctggccctgggcaaaaccagcccatccccggacagctcctctcctgcctctgtgtctgcgaaggactcggggggaaatatctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttttaatgcagactttccttttgtgtttccaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggtaagatcctgagctgccatctggggactttattcataggcactaggtacttcacagagaaacttttctcctctctgttgcaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaaaaaaaaaaaaaaaaaaaaaaaaaagggggggggggctaagaaatttccccgggggggcccaattttggcggtcacccccgctttctttgggctcccacggggtccccctatggggagcgcgtatataaataacgcattggccacaggcgccgcgggtttcaaaccccgctcgttggccgggcggaaaacccggctccccctggcactcctcggggaagggacccttaactctgtgggcgttggcgccatctgtggcaccacctcccctcagagaatctatcgcgccgagggcaaatataccctctcacccgctcttcaccgggtacccaccgcccattatgtcttggcgcttgaaactttgggcacgcgcctctattctcacactcttc

SEQ ID NO: 735691 - DNA, 1850 bp, Homo sapiens
gcatgagtctccggcagggctgtgaaggtttccgggaagccagccaatcattcccaacggaaactcagtagcggcattttcaactggataaactggccttagtcccgccttctcgttccagagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtaattatttttggaattgataaaaataaaaataagattgattagctttg

SEQ ID NO: 735692 - DNA, 2255 bp, Homo sapiens
gcatgagtctccggcagggctgtgaaggtttccgggaagccagccaatcattcccaacggaaactcagtagcggcattttcaactggataaactggccttagtcccgccttctcgttccagagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcattttt

SEQ ID NO: 735693 - DNA, 1414 bp, Homo sapiens
  misc_feature (423)..(423): n is a, c, g, or t
  misc_feature (973)..(973): n is a, c, g, or t
aagctactaaagaaaagccagaaacagcgtaagaattccctactcaaatatgattcagagacgagggtggggactttattccactggacttcagtcccagtgacaaggccactactattgtgaattaatatcaggctaattaaacttgatgttattaaatgttctatccataaaatttttcattcagaattcttgtttttcaaacaacattctggattattatttagctgtcaaagtagctgtgttcttagaaaatacatcagtcagggctgggtacagtggctcatgtctgtaatcctagtgctttgggaggccaagacaggaggatcacatgaggccaggagtttgagaccaactaagtcaacatggtaggaccctgtctctatccccctctaccccccaaaaaattagtcagacatggtngcacatgcttgtagtcctagctacttgggaggctgaggtgggaggatctcttgagcccaagagttcaaggtagcagtgagctgattgcactactgcactctggctcatgcaagataggaagaccctgtctcagaaaagattaaaagaaaataaactaatcacacaaatttcaaatatactatttataatggtagaaacattttagtgagcaatgatcctggcctttagtgaggtttttctcataacaatttgtcataaatgaataatttctgggtaaaacattataatttcattttttctttatttatttatttttatttttatttttgaaacagaatctcattttgttgtccaggctggagtgtccgcctcccaggctccagtgatcctccagcctcagcctcttgagtagctgggactacaggcatgctccaccacgctcggctaatttttgtattttttgttgagaaggggttgtgccatggtgtccaggcttgacttgaactcctgggctcaaacaatcagcctgctttggcctcccaaagtgctngaactacaggcatgagccatggagcccaacctgtgatttctttgctgtgtacccccatttgatggataattttttggcatgttgataaacgtcagggtgtaaagtatccagtatgaggggtaaagccaggattataataaatttgtcaacttcaggttttcttgctagccttttctgtgatatacaaagtgcacatacaactacatgggtaggagaattgttgaaataagttatcattgttcaaacaataatttgttggaaccaaatatcacccacaatgcaattgtctacctttaaagaatggccatagagtcaaaaactttcttttgaatcctggattcactatttatttgatgtgagatcacctttacttttataccatcaatttcctcagtgtaaagagtgtattattaaaattccctcgtacggtcaaaaaaaaat

SEQ ID NO: 735694 - DNA, 1152 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacgggtgagttgcatgtcttgggaatactatgagttagagaaagtcggccaaggtacctggtattttaagggctatatatgaatagaagacttttattgaaagtcttcaatatgcctat

SEQ ID NO: 735695 - DNA, 1713 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgagggaatgcttggtatatacctgaacttctgtagtacctgtgtttactttccggatgattctccttggggacaatggatgcattgactcaaccaac

SEQ ID NO: 735696 - DNA, 6467 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735697 - DNA, 3190 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtaattatcaactctttactttatgtttttctataggttaatctaatccttttcaggtccaagggtttttctcaatccaagtctttgatgtctcccctttcccaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaagtaagcatagaattagcagacattttccacctcaaacttctacagtgttac

SEQ ID NO: 735698 - DNA, 1237 bp, Homo sapiens; identical to SEQ ID NO: 339925

SEQ ID NO: 735699 - DNA, 1837 bp, Homo sapiens; identical to SEQ ID NO: 339934

SEQ ID NO: 735700 - DNA, 2597 bp, Homo sapiens
atggtctgacgatctctttttcgcacgctggagttgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735701 - DNA, 3649 bp, Homo sapiens; identical to SEQ ID NO: 339931

SEQ ID NO: 735702 - DNA, 4770 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaagtgagtgcatgtgacaggctgttggcccccttccctatttccccctctcttctctttcccttttctaaatgcatcctcttgagagagatttggattttgatttgataaaatgtcaaaagagtgccattctttgggcctttattc

SEQ ID NO: 735703 - DNA, 6866 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcggtgagtggcagtcccatccagcaagatttaaagtcattcctttggtatttaagctgcatgagaaagagaaagcatgacatactgtgtcatcgtttctgtatctgcaagataagggtaataattaataatacccagtcttccaacctcacaattgttgtgatgcccaaaataaaataatgttgaagtactttaagtgctaggcaaatatttactattgaactattatataaaccacctaatattttttggagagatcccacttaatggcagttttccactaggatgaatcctttatctatgtaataagtgtttattatcaaacaaaagacactagtactttaataattactccagagaagatttctattcctctaggataactgattttttctattgcagtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735704 - DNA, 6142 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735705 - DNA, 6404 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735706 - DNA, 5153 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgtcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattcctagcctctggcagagcctgttcctggccgaactgtggatacagctggagggtcaggaactgttaccttctttccccttggcattaataaatttaagttaatcctt

SEQ ID NO: 735707 - DNA, 4031 bp, Homo sapiens
aagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtacgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgattggagaccaagcagaaaagtgtttagggggtgcgattccagtgagattgacatatggttcccagtagtggatcaactggaggttccaacaacttggtgggacagtgaggcttacaagtcgctg

SEQ ID NO: 735708 - DNA, 2705 bp, Homo sapiens
tgctgttggtctgtctctagagtatccccgtctcacttctgaatcccgactacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 735709 - DNA, 1691 bp, Homo sapiens
  misc_feature (1668)..(1669): n is a, c, g, or t
tgtgagttcctttcccttgttcagtggttaatgcatactaagttggtttaatttaaaaaaaaaaaagaggtttaacagtataagggaaaccaccagaagtacaaaagccacagtatcaccatcaaaaccagaaagcctgaggatgaagaaggaaagatgtgtatatctgatacaggtttcataattgatagtcaaaagatatcatccaaatttattagatcactagatattaaaacaaacaagacaaaaaggaagacaaattcattaaaaacaggacatttctcccagctatttgggaggctgtggtgggaagatcaattgagccggtaggtagagacttcagtgagccgtgatcctactgcactctagtgagggcaacagagtgagaccctgtctcaaaaacaaaaacaaatgacatttctcttaaaaaatttttgtttcgtttttttgagacagagtctcatcccgtcatccaggctggagtgcagtggcctgatcttggctcactgcaacctccgcctcccgggttcaagccattctcctgcctcagccacctgagtagctgggattacaggcccgcaccaccacactcggctaatttttagtagagacagggcttcaccatgttggccaggctggtctcaaactcctgacctcaactgatccacccacctcggcctcccaaagtactgggattacaggcgtgagccactgtacccagcccaacatttcttttgctcatgaatctgcagactgggcagactgtttctcagctcagcttatgttggctcccctcagtgtcaactaggattgcttgaaggctggggctggaaatgtttaaatcttatccacatgtctgtgcctgggctgggaagactcatgcagctggggttggagcaggtgggcctcctgggtatccctctctctacgtgaaacactgtacgcagcctctccagtatggtggcttcagggtagccaattaagatatggttttacaatctattaaactggtaaatgtgatgcccaaggctggcaaggatagatctattgttggcaagggtaagctgactaaaccacttgggagggcaatttggcaatacacaccaaaatgttaaattccgtttgctctaataattctactgctaggaatttacctttcagatataaacaaaagtgtaccgaaatattttgtatgaaaatgtccactgcagcactgaatataccagcaaaaaatctgaacactcaagtgtccatcagcagggactatgcagtgaaacagtggttcaaacctcaccatcaccctgctgatgtaggacaccttcagctatggcctgcactactgaagcacctcccagctcacggctcacacctgctggggtcctcttctgatcacttctcctgtgcaaccagtgcaacctggactgcctttcacacccaccccatcacaattaagatccaccagggcgtcccaaactcctaccaaactccatgtgctacgctcctccaacctgggcctgcactgggccccagcctccccgctggccttcctgctgcctctccctctgccacttctagccacagggtcttagctcagactgtttcctctgcctgccttactctatttctcctctcctcctcttgccctcagagaaggcctctgtaacaccnngcctcgtacctagccgtaggtt

SEQ ID NO: 735710 - DNA, 2982 bp, Homo sapiens
tgcttggaaagtggccctttattcaacaaaagtatcataagaaaagtggcttagtctcaccctcctacccaattcctgctattcagactggccaggggtcctgcatcttcttcaacattctagctgatgcctagcgtttgtacagtcctttgcagcttgcaaaactcttatttgttccagaaaactaaagcccagagaacctacatggcttgtccaaggccaggcagcttcggtggtgaagcctagcacaggcttgctggctgtgctggaagaagccatccaggagggacatgtcagcatgacacccattatcatcacaaaaactaggtgcagggagagtcctcagagaggctgtatgggcggcagagaagctccacgggcaataatgataatgatcattgtggttgctattcaatgttcagccttgcactttgcacaacatgttataattatctcacttactcattaataacctgtgcagcaggtactattatttccatttaagatgaggacaccaagaatttaacagccaagccacttgcttaaggttaggacttggatcctaatcttcctaactcaaagctgggcttcttagttatacaccatcctcactatggaaaacatcaaaatcagaaacccatcatatggggcaatgagaaaaatcagaagcaatgcaaacccttcaaaccagccaaaggaggacataaggaaaagagaagtatcctttccagcccagtcctgaaatcattttggagcctctgtcttttaaattaagatcccggttgccaaaagctgatgtatgtaaggtgacctaagttgaatggcactttcccggtggtgataaatgcatgttgcctgccaagatgggctgagtatagacgtggattcccatgcccctcggatgctcaagctgtgaactgcaagatggagagtgctgtgtgggtttcaggggtttagagttctaatctggggtgcaccatttactccacactcttggtcagatttcttcacctctcagaactctttctagagccacagagtgatagagtggggaaggagatcttgtagatcaatgccatcatttgatggatgggaacactgggcttcagagaggggcagggacttgctggttgtcctaggggcagctcgaaggtaggcaggttcctaggaggtctcctcccttacagtttgccccatttcctgctgtgcatggctcccctgtctacaacaaagccatcaccctgcctaggtggcagtgaggctcaggtgagaccctgcctgccccatacaaacacatgtcaggcaccatcagtagctgagcacagagctcttcccaaggggccacagtgcagtgtggctaggcggtacctggtgggcgtggggggctggcgatggggagccatggaacggggtggggcagccgtcctctcatagggcttttgctcaggagactcatcattgcttttcagaagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtcaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtgcagttgcctgagaccactcccaccccaggagctgggcaaagagctctccacgtccacctgtccccccacagcgcgtcactgctgccccatcacaggtcttctcttttattcccagctcgattttcttccttggaagaccgagatttcagatctccttccttcttttttttgcccttgtcttgctttgttttatttttctctttgcttcctcctcctttgccggggtacacctggccctccagagttacatcagcacacctgtcttgaccgaccaaaaagtccttgatctcccaggcgtagctcccatcgcgaagcatgaagatagcacggtctgatcccacaatgaacctctggacgtcatagttggcattgaaaaggctgccctgccagaggctcgtaatttcctctgtctccttctcagtagggcttcctgatacagtgacaaacatcatgagagtcttcccttttttcgtcattttcaatatgctttcaggcttgcttgggtctatctttgagaagtcgacaggtgctgaaggtctcttgtgctctggaagatctccttcttcaatgtcatcatctttctcccattgctccagaagacgcgccatgtctgcatcattgtaatcgcgaatatccttcttcttcttccggggaggtggggtagactcgtcgggcgtcccgggcgagccttcggccgcgcaggacccaggcggtggtagcagtagcagcagcagcagcaggtcagaggcacaaagcaggaccacggccttgcgcgcccacctggaagccgccattttcgctgcgccgcgcagcgccctagacgcgcttacccgacctgcgcgggccggaccccgccttgcacacgccttcctg

SEQ ID NO: 735711 - DNA, 655 bp, Homo sapiens
tatgaagatgaacagaaagcattagctggattacacagtaaggcctgggctgcgtccatcagcagaaagagatgtccccttatttggcctttctttcattcaagccttctaaaaagggttctgtaaagagaaagtgcctttgaaagtgcggtctatagtcagatgttagccagacgctcttggaataatccttcgtaatagcctcattgtgtgtttcctttttgggttttaaaagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagtgagtgggtgtccagccaggagcagtgagctcaaagctgataacgatgccttgttgcaaagtcctggacttgcgtctaacgaaaccacaggctagcccatgtgatccatgcaggagtacctagaggggttgacatcacccaggagttaagaattaaaggacacagccatcgagcccccgctccagcatgggtaaccttggccagcgc

SEQ ID NO: 735712 - DNA, 467 bp, Homo sapiens; identical to SEQ ID NO: 364019

SEQ ID NO: 735713 - DNA, 3620 bp, Homo sapiens
  misc_feature (2899)..(2899): n is a, c, g, or t
tgactggctatactttccttccttattaccccagtctggtccctttggtctctatgccaaagatgacagcagctgcagcccttgctctaaattgcatgtctttgaatgatagtcatggtcaggatgcagacacaccctggctctgggatgggccccagctggcagggatcatgccctccctggaggcctgctccctaaattctccacctggccttgtagctgctcaccagccagccctcatccactgagacctcactctgtgccaggccctgggctgaatgctggggacaagggggcaaaaaccagctccttgcccacccagagcccaccatgcggtgggaggaggcagacatttgaacaaaagacattaggcggcttccaccttagggcaagagtggatggggcttagaagtgttgtgatgtagttacataagtctgggttcaagttttagctctgccacctactggctttgtgatcctgggtaagtaactgaacctctctgaggatgagtttccttatctgtaaaactaacagcagcctcatagttttgctatgaagatgaaatgagataatataggtaagcatctagctttagtggttctcaaactttcttgcccattagaatcacctgggcaacttttcaaagtccagatgtccatgctgcaccccagacacaatcaaatctgaggctccgaggatggggactgggcatgagtattttttaaagactcctccccatgggatgcagaaccatgtttggactgttggccgctgttcatggtgctggtagtggtggtgcaaattgtaaaaagtggccagcccagatcctagaagagtggctacttattgtaaatgctccgtaaaatgttcacccagccataagcagtagatcactggtttcgatactgagtactgtaggacctcaggccaggcatttatctattccaagactttaggctgtctttctcataacaaaactgatgggggcaatcattgggataatcatctcgggccgttgtaaatagtgttgcagcagggacaattttagacttctgagtatatgtttagaacattaatcagcaccttccttctctataaaaaaaaaacgactttgctctgtaatttctgtgtcattcccaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcaggtaggacttttactaatcccttcctagactggatgaatctgaaaattgttaggcttaaagtaaactgaagttacaacaaatctgtatcagtcagctatggctgtaataatgctgcataacaaaaaaaatcttaaaacttcatgacaggtctttatttcttactcatgtatctgcaggttgtctagggatcagcttctctagactgagcctgactccaggctgagagttgggttcaagtcacttccatatgactcccattcttcccaaaacatattcttctcacgggggagattgcaaactcctagtggtgagcagaaacacagaactcttaaggcctaggctcaaagatggcacattctcacacattccattggctaaagtaagtcacatggtaaagcacaacacaaataggctagggaagcatatgtctgtcaccaagtttgagggggaggaagtgaatatttgttagacagttattcaatctactacaaaatttttaatctcttgtatctgtgagtttggggtttttctttttcttctcctaaatcttgatttagatgtcctgtaatttatgttattggaggttactggaatcacagattgttgaaggtaaaaagagacttcaaatataatccaggtcaattattcttagtagggggagttatgtatcaattagagttctttggntgttagcaacagaatccaacttgactatcttaagcaaaacaggaatttattgagaggctattcaacttggagaactaaaggataagctgaataactaacctccaaaaggacagggaacagggtagcttctgggatctgggtagcaggaactaatggactgtatccttaaggcatcatctttaagaaccatgcttaggccatgggacatagtgctcaaaagtcaccttccagggagagagcatctgcttgggctggtggcttgtgtgctcaccctttggctaggaaaggcaggaacagtcattgaaagttcttctaagactgcattaaatggataaatggctgttccgcaaaggaaaattgggatatattaccagaagaaaggggaatcagaacttaagaggtgttaaacgtatcacatgctacaggaccataccacctggaggagtattagaatatggggttgggagaaagaccatggattgagaaagcgtatccaatatactcaccatatctattattttggaaagaaacccacagaacataaaattcaacacaatctttttggctgcctgagatgtgcttgtggaagaatctgtggaggcaaagtttaaaaaatctgagaacactgatggaattcagtccccttatcttaacactcatgggggaggcggacctagaggtcatgtggtggaggcagtccacaaacaatgcagctgtgatg

SEQ ID NO: 735714 - DNA, 931 bp, Homo sapiens
gagaccccgtctcaaaaaaatttaaaaaaaaagagctaaagcgacactttagatgggccttcaggacacagtagtagcctcctttgcccagcaaaggctgcgggaagcgctgcagttctaatgccaaggaggaattcagaccgtgagacatgctagagctctgcaatctgaatttgttgggaggctggaactaaactttcaaaactgaaacaaaagaatggatgatcatctcttcccaagtgaatgaatgtcctaattttcttttatttacttaaaaaatatttttaaagaaatgagtcaatgcccatgtgcgtaggggggtttccttgccttggagtcacaactttttgaatttgggggtctgtccagctcctaaagggtctcgtttctctgacaggacatcgaggctctgctgctgcccgggtattcaaattgttccagacagagcatggcgaatatttcaatgtttctttgtccagtgagtgggttcaaggtgaggagtttcagacaatttggtgacacctaacagtgggatagaagaccagaaatcactgtctttgcagaactaggatttatctcttataccagtaggaccactttaatttttgcagaatcaactaaaaatgtgcaaccaaaagttgtctttaattagacaagccactttagcccatagcccagaaggatgttctcctctggctaagatttcaatttcacctcagtcagggtctgcggcattcagcttagttcacggaatatctttgatgtggcaggcaatggcactgaacaggaaatgcagataggaatagaacctgccctccaaatagcccacatgcagggattgcagaaagcagcaatcctagttgcagtccttggataacgggtttacagatggattttctttcttttctctttaatttgcttttgcaataac

SEQ ID NO: 735715 - DNA, 4678 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccgatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatcaagtct

SEQ ID NO: 735716 - DNA, 918 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatcaagtgcgtgtgagggtcggagct

SEQ ID NO: 735717 - DNA, 442 bp, Homo sapiens
gaggttgaaaatattccaaataatttgcacctgtaccgaacatgtacagatttttccttgtcattatttccttaaaatacagtttgacaactatttatacagtatttacattgaactaggtattataagcaatctagagatgatttcaagtatatgggaggatgtgcataggttagatgcaaatatgcaaatactatgccatttaatcagcgactggagcatccatggagtttggtatctgggaggtgctggaaccaattcccttcagatactgagggatgactttacttgtaagtacaccaagcataggaatgtttggaagatgtgcctttttgcctgccccggtgagatggggagtgcttagggagtctgcccttggctctgatataaccttacccttaacactgtgttattaaacctccccccaatgctacctcttcag

SEQ ID NO: 735718 - DNA, 698 bp, Homo sapiens; identical to SEQ ID NO: 364017

SEQ ID NO: 735719 - DNA, 3892 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcaggtaggacttttactaatcccttcctagactggatgaatctgaaaattgttaggcttaaagtaaactgaagttacaacaaatctgtatcagtcagctatggctgtaataatgctgcataacaaaaaaaatcttaaaacttcatgacaggtctttatttcttactcatgtatctgcaggttgtctagggatcagcttctctagactgagcctgactccaggctgagagttgggttcaagtcacttccatatgactcccattcttcccaaaacatattcttctcacgggggagattgcaaactccatatctattattttggaaagaaacccacagaacataaaattcaacacaatctttttggctgcctgagatgtgcttgtggaagaatcaaaggtaccaagcagagatgggagagtgattactttgtggtggtttctgggagtccagtttttcctgtacttcattggcatcacatgaaatctggagatcattccacggccacacagcatgacagctctgctaactgcagacagggggatcatgcgaagacccggctgtggtatctacccaacagatttgagatggtgacaacaatgggctttttttcttctgatgaaccaagtgttccttcaggagcaagtgctggtgggcgtggggggctggcgatggggagccatggaacggggtggggcagccgtcctctcatagggcttttgctcaggagactcatcattgcttttcagaagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctcccattgctccagaagacgcgccatgtctgcatcattgtaatcgcgaatatccttcttcttcttccggggaggtggggtagactcgtcgggcgtcccgggcgagccttcggccgcgcaggacccaggcggtggtagcagtagcagcagcagcagcaggtcagaggcacaaagcaggaccacggccttgcgcgcccacctggaagccgccattttcgctgcgccgcgcagcgccctagacgcgcttacccgacctgcgcgggccggaccccgccttgcacacgccttcctg

SEQ ID NO: 735720 - DNA, 3064 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcaggtaggacttttactaatcccttcctagactggatgaatctgaaaattgttaggcttaaagtaaactgaagttacaacaaatctgtatcagtcagctatggctgtaataatgctgcataacaaaaaaaatcttaaaacttcatgacaggtctttatttcttactcatgtatctgcaggttgtctagggatcagcttctctagactgagcctgactccaggctgagagttgggttcaagtcacttccatatgactcccattcttcccaaaacatattcttctcacgggggagattgcaaactccatatctattattttggaaagaaacccacagaacataaaattcaacacaatctttttggctgcctgagatgtgcttgtggaagaatcaaaggtaccaagcagagatgggagagtgattactttgtggtggtttctgggagtccagtttttcctgtacttcattggcatcacatgaaatctggagatcattccacggccacacagcatgacagctctgctaactgcagacagggggatcatgcgaagacccggctgtggtatctacccaacagatggtgggtcgttctctccttaattataacattcacagccacagaactaatcatattttatatcttcttcgaaa

SEQ ID NO: 735721 - DNA, 6282 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcaggtaggacttttactaatcccttcctagactggatgaatctgaaaattgttaggcttaaagtaaactgaagttacaacaaatctgtatcagtcagctatggctgtaataatgctgcataacaaaaaaaatcttaaaacttcatgacaggtctttatttcttactcatgtatctgcaggttgtctagggatcagcttctctagactgagcctgactccaggctgagagttgggttcaagtcacttccatatgactcccattcttcccaaaacatattcttctcacgggggagattgcaaactccatatctattattttggaaagaaacccacagaacataaaattcaacacaatctttttggctgcctgagatgtgcttgtggaagaatctagggacacagctatctcttaggcttctcttccccaggctggctgcagacacggacacgatctccctgggtccttcttcctcattgctcccagatttcattctacaggactgtttgcatttcccttaaggcctttcaaaggtaccaagcagagatgggagagtgattactttgtggtggtttctgggagtccagtttttcctgtacttcattggcatcacatgaaatctggagatcattccacggccacacagcatgacagctctgctaactgcagacagggggatcatgcgaagacccggctgtggtatctacccaacagatttgagatggtgacaacaatgggctttttttcttctgatgaaccaagtgttccttcaggagcaagtgctggtgggcgtggggggctggcgatggggagccatggaacggggtggggcagccgtcctctcatagggcttttgctcaggagactcatcattgcttttcagaagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatcaagtct

SEQ ID NO: 735722 - DNA, 4164 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagtaggtttgcaaccatgtagctccttattctgagtggcttaacctaagtggctgtgatggaagggaaaaagttaatgggtagtttctacctgttgactatgaattcttctaccagccagaggaatcactgaggtgactgagactaacaattaagggatgaaatctggaatggggagagagaagtcaaaaagtggtgttgaatatgagtcaacagggtgacgtggccatcaaaatgcgtaatgcattcctgggctatgttaatgggaatttagtgtgtctgggatcagggactgtgagtccttttctctgacagcactctcacttggagtgtagcatccactcctgaggatggcagagcaatagagtcaggccgaagcacacttaaaggagaataaccaggagggtgacaaaagccgaagctatgtcacatgcaggttggggtcttcaaccagaagacaggatcatcactttggggacaacatgggggatattgttacatgttctcagagctgctgtgcacataggggatgagactcattctacacg

SEQ ID NO: 735723 - DNA, 7950 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatcaagtct

SEQ ID NO: 735724 - DNA, 6475 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaataaagcagcaggtggtgagccacctgatcgagaagctgccacagcagcgtgggtgagaagtcgacccccagccgaggtg

SEQ ID NO: 735725 - DNA, 7857 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatcctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatcatcaagtct

SEQ ID NO: 735726 - DNA, 6276 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctttaacataatgaaaatgatgtatatggcatgaagagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtgcagttgcctgagaccactcccaccccaggagctgggcaaagagctctccacgtccacctgtccccccacagcgcgtcactgctgccccatcacaggtcttctcttttattcccagctcgattttcttccttggaagaccgagatttcagatctccttccttcttttttttgcccttgtcttgctttgttttatttttctctttgcttcctcctcctttgccggggtacacctggccctccagagttacatcagcacacctgtcttgaccgaccaaaaagtccttgatctcccaggcgtagctcccatcgcgaagcatgaagatagcacggtctgatcccacaatgaaccttgggcagagagatgcaatcagtcagccagcacgtactagtaaggtgctaaggggtcagagcaattctctggcacttatcagtttatttcaaattctacatgaatatggaatgaaaaattggattttccaaagcctagcagctactgatatctcatgta

SEQ ID NO: 735727 - DNA, 6641 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctttaacataatgaaaatgatgtatatggcatgaagagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtgcagttgcctgagaccactcccaccccaggagctgggcaaagagctctccacgtccacctgtccccccacagcgcgtcactgctgccccatcacaggtcttctcttttattcccagctcgattttcttccttggaagaccgagatttcagatctccttccttcttttttttgcccttgtcttgctttgttttatttttctctttgcttcctcctcctttgccggggtacacctggccctccagagttacatcagcacacctgtcttgaccgaccaaaaagtccttgatctcccaggcgtagctcccatcgcgaagcatgaagatagcacggtctgatcccacaatgaacctctggacgtcatagttggcattgaaaaggctgccctgccagaggctcgtaatttcctctgtctccttctcagtagggcttcctgatacagtgacaaacatcatgagagtcttcccttttttcgtcattttcaatatgctttcaggcttgcttgggtctatctttgagaagtcgacaggtgctgaaggtctcttgtgctctggaagatctccttcttcaatgtcatcatctttctcccattgctccagaagacgcgccatgtctgcatcattgtaatcgcgaatatccttcttcttcttccggggaggtggggtagactcgtcgggcgtcccgggcgagccttcggccgcgcaggacccaggcggtggtagcagtagcagcagcagcagcaggtcagaggcacaaagcaggaccacggccttgcgcgcccacctggaagccgccattttcgctgcgccgcgcagcgccctagacgcgcttacccgacctgcgcgggccggaccccgccttgcacacgccttcctg

SEQ ID NO: 735728 - DNA, 6617 bp, Homo sapiens
  misc_feature (6594)..(6595): n is a, c, g, or t
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctttaacataatgaaaatgatgtatatggcatgaagagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtgcagttgcctgagaccactcccaccccaggagctgggcaaagagctctccacgtccacctgtccccccacagcgcgtcactgctgccccatcacaggtcttctcttttattcccagctcgattttcttccttggaagaccgagatttcagatctccttccttcttttttttgcccttgtcttgctttgttttatttttctctttgcttcctcctcctttgccggggtacacctggccctccagagttacatcagcacacctgtcttgaccgaccaaaaagtccttgatctcccaggcgtagctcccatcgcgaagcatgaagatagcacggtctgatcccacaatgaacctctggacgtcatagttggcattgaaaaggctgccctgccagaggctcgtaatttcctctgtctccttctcagtagggcttcctgatacagtgacaaacatcatgagagtcttcccttttttcgtcattttcaatatgctttcaggcttgcttgggtctatctttgagaagtcgacaggtgctgaaggtctcttgtgctctggaagatctccttcttcaatgtcatcatctttctcccattgctccagaagacgcgccatgtctgcatcattgtaatcgcgaatatccttcttcttcttccggggaggtggggtagactcgtcgggcgtcccgggcgagccttcggccgcgcaggacccaggcggtggtagcagtagcagcagcagcagcaggtcagaggcacaaagcaggaccacggccttgcgcgcccacctggaagccgccattttcgctgcgccgcgcagcgcccttaacaccnngcctcgtacctagccgtaggtt

SEQ ID NO: 735729 - DNA, 6346 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctttaacataatgaaaatgatgtatatggcatgaagagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtgcagttgcctgagaccactcccaccccaggagctgggcaaagagctctccacgtccacctgtccccccacagcgcgtcactgctgccccatcacaggtcttctcttttattcccagctcgattttcttccttggaagaccgagatttcagatctccttccttcttttttttgcccttgtcttgctttgttttatttttctctttgcttcctcctcctttgccggggtacacctggccctccagagttacatcagcacacctgtcttgaccgaccaaaaagtccttgatctcccaggcgtagctcccatcgcgaagcatgaagatagcacggtctgatcccacaatgaacctctggacgtcatagttggcattgaaaaggctgccctgccagaggctcgtaatttcctctgtctccttctcagtagggcttcctgatacagtgacaaacatcatgagagtcttcccttttttcgtcattttcaatatgctttcaggcttgcttgggtctatctttgagaagtcgacaggtgctgaaggtctcttgtgggccaggtgtaccccggcaaaggaggaggaagc

SEQ ID NO: 735730 - DNA, 6145 bp, Homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctggtaagcagccccttgtcggggacacagatgcaactatggctcggttccttgaactggcagctatgcaggcaacttccagacctctcagtgagacagtgctcccaaaggagagcacttttgtgacacgggagcagtgggaggatccttggagttggcaggagacagcagaaccccaccctgcccataagcctttcaggaaggggaagggcctggtccaaggcagtcaaggtacaaatggacagagctgccctcccctgcagagatgtgcagttctttgcctctttgggtgctattattttaaatccagtacctaaggtgcttgttagaagagattggaaatggtcgggttgttctcggaggcacttggccatctccagaaggcagtcattaggaatgaaagtttagggggagaagtttatggctaccgaaaataatagttgagaggaactatatttgttttacatcttgagcaaagtgggtggggtgaggcagccacatttaactccagctaagaagttagtggaaaattcccccgcccagagctaatgaatggctcttttctggtagggtttttgttgacttcaaaaacctttaccaagagtgggatggagcaagccagtgatctgggttttggataggcaaacctggcatttagttatttagggaggggaagggaaaaaagaggtagccaaaagtttgccaagagcaaagggctctatctcagtctttcctgttttgggttacagtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatcccttgccttgccccaaggcggggtgtccataagagcaggtggagatggttcaaagaaagagaagatatcattcatatggctggccatgtccagaacttgctgcgtcctccacatttctaagctgtcaggaggctgtcacttcaactcccctccccgatggggaagccaggcagaagcaggactctcttttcctcccaggccctgtttggctggaggccaaacacatttgacaagagcatgggggctgaggtgggaaaaacaggtccaaatcaaactggcagacgagaggcaggcacaggtagagggcacctcaggcagcactggaaggggctcaggggtctttaacataatgaaaatgatgtatatggcatgaagagtttactcaattaagtcaagagttttaaagtcttctctgatcagaatttgctatctgatcagagcaggccacccaatcacagcaggtgcttggaggggagtggaatctcagtagagttgatgactcaccaagtgtaaatgggaaaaagcaacacagtcacatttccatgtaaggagattttatagtaaacatgaatttgtcagtgtccagtattaattagaaaacatctgtcttcttacttgaagcctattaagcagtaattctttgaccacaaactggtcatgtggcagaccctttctagaagacactagaatgtcatccggtgtggaaaaccaatggcttagagtgggtcatgataagaggctatgaaggactcaagaggacacttggttgttggacaaaaatcctagcccttgagcttagcagcaagctgcccagctcgtccacactcgaaaggtcccaaggaacaaagcggaaagaatgaggcctgggtggagccctagtgtggccagcgggcaagattcttctgttccttagggactacaccacgcgttcccccttcagtttctaatgctcccaccactccacagagaccagtgggccttctggagcagacatcaccaagacatttatttgttctgtctaggtgtctatttaagctaattgaaaatattttgctggccggacactctctaagtactcct

SEQ ID NO: 735731 - DNA, 1153 bp, Homo sapiens
tgtttgcttggggatctgatcctgtagtgatgaccattgagaatgttgctgtgcgttcagccatgcaccgccatgggtgttcactgggctttctgacctctcgtggccttctttcgtccttttgatggtatgggcttcctgtttccagaaacctcatctctctcaagaagatccttgatgtgctttgagatttcacagggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctg

SEQ ID NO: 735732 - DNA, 893 bp, Homo sapiens; identical to SEQ ID NO: 263931

SEQ ID NO: 735733 - DNA, 1298 bp, Homo sapiens
tgctgagttccctgcactctcagtagggacaggccctatgctgccacctgtacatgctatctgaaggacagcctccagggcacacagaggatggtatttacacatgcacacatggctactgatggggcaagcacttcacaacccctcatgatcacgtgcagcagacaatgtggcctctgcagagggggaacggagaccggaggctgagactggcaaggctggacctgagtgtcgtcacctaaattcagacggggaactgcccctgcacatagtgaacggctcactgagcaaaccccgagtcccgaccaccgcctcagtgtggtctagctcctcacctgcttccatcctccctggtgcggggtgggcccagtgatatcagctgcctgctgttccccagatgtgccaagtgcattcttgtgtgcttgcatctcatggaacgccatttccccagacatccctgtggctggctcctgatgcccgaggcccaagtgtctgatgctttaaggcacatcaccccactcatgcttttccatgttctttggccgcagcaaggccgctctcactgcaaagttaactctgatgcgtgtgtaacacgacatcctcctcccagtcgcccctgtagctcccctacctccaagagcccagcccttgcccacagggccatactccacgtgcagagcagcctcagcactcaccgggcacgagcgagcctgtgtggtgcgcagggatgagaaggcagaggcgcgactggggttcatgaggaagggcaggaggagggtgtgggatggtggaggggtttgagaaggcagaggcgcgactggggttcatgaggaaagggagggggaggatgtgggatggtggaggggctgcagactctgggctagggaaagctgggatgtctctaaaggttggaatgaatggcctagaatccgacccaataagccaaagccacttccaccaacgttagaaggccttggcccccagagagccaatttcacaatccagaagtccccgtgccctaaagggtctgccctgattactcctggctccttgtgtgcagggggctcaggcatggcagggctgggagtaccagcaggcactcaagcggcttaagtgttccatgacagactggtatgaaggtggccacaattcagaaagaaaaaagaagagcaccatctccttccagtgaggaagcggggccaccacccagcgtgtgctccatcttttctggctggggaggaccctttacagcagatgaaggcctctccccagcgtgtgctccatcttttctggctggg

SEQ ID NO: 735734 - DNA, 1968 bp, Homo sapiens
tgctgagttccctgcactctcagtagggacaggccctatgctgccacctgtacatgctatctgaaggacagcctccagggcacacagaggatggtatttacacatgcacacatggctactgatggggcaagcacttcacaacccctcatgatcacgtgcagcagacaatgtggcctctgcagagggggaacggagaccggaggctgagactggcaaggctggacctgagtgtcgtcacctaaattcagacggggaactgcccctgcacatagtgaacggctcactgagcaaaccccgagtcccgaccaccgcctcagtgtggtctagctcctcacctgcttccatcctccctggtgcggggtgggcccagtgatatcagctgcctgctgttccccagatgtgccaagtgcattcttgtgtgcttgcatctcatggaacgccatttccccagacatccctgtggctggctcctgatgcccgaggcccaagtgtctgatgctttaaggcacatcaccccactcatgcttttccatgttctttggccgcagcaaggccgctctcactgcaaagttaactctgatgcgtgtgtaacacgacatcctcctcccagtcgcccctgtagctcccctacctccaagagcccagcccttgcccacagggccatactccacgtgcagagcagcctcagcactcaccgggcacgagcgagcctgtgtggtgcgcagggatgagaaggcagaggcgcgactggggttcatgaggaagggcaggaggagggtgtgggatggtggaggggtttgagaaggcagaggcgcgactggggttcatgaggaaagggagggggaggatgtgggatggtggaggggctgcagactctgggctagggaaagctgggatgtctctaaaggttggaatgaatggcctagaatccgacccaataagccaaagccacttccaccaacgttagaaggccttggcccccagagagccaatttcacaatccagaagtccccgtgccctaaagggtctgccctgattactcctggctccttgtgtgcagggggctcaggcatggcagggctgggagtaccagcaggcactcaagcggcttaagtgttccatgacagactggtatgaaggtggccacaattcagaaagaaaaaagaagagcaccatctccttccagtgaggaagcggggccaccacccagcgtgtgctccatcttttctggctggggagaggccttcatctgctgtaaagggtcctccagcacaagctgtcttaattgaccctagttcccagggcagcctcgttctgccttgggtgctgacacgaccttcggtaggtgcataagctctgcattcgaggtccacaggggcagtgggagggaactgagactggggagggacaaaggctgctctgtcctggtgctcccacaaaggagaagggctgatcactcaaagttgcgaacaccaagctcaacaatgagccctggaaaatttctggaatggattattaaacagagagtctgtaagcacttagaaaagggcacggtgagtcccaggggccagcactgctcgcaatgtacggcatttctctttgtaacaggattagtagcctgctgtgcccagggagaacatgcagcacagcgcatctcgagtcagcaggattttgacggcttctaacaaaatcttgtagacaagatggagctatgggggttggaggagagaacatataggaaaaatcagagccaaatgaaccacagccccaaagggcacagttgaacaatggactgattccagccttgcacggagggatctggcagagtccatccagttcattcaacacctggttagaaaactggggccagcacacaggggaagggtaagctggtttcatgatcgaatcaaggctcagacaatttttaaaggccagagggtagactgcaatcaccaagatgaaatttac

SEQ ID NO: 735735 - DNA, 630 bp, Homo sapiens
ccgagctatgcaccactgagtttgtgtcttagtatagacaggttcgccatgtcggtcaagctgatctcgaacgcctgcactcagttgatctacctgccttgccctcccaaaatgttggaattacaggcatgagccactgtgccctgccacaattattgtttaaaatgcattattttattctagatttatgtacatggtgacatctgtgtttcggtacaattttgaacttgtatttcaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttcctgtag

SEQ ID NO: 735736 - DNA, 1096 bp, Homo sapiens
gttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttcctgtag

SEQ ID NO: 735737 - DNA, 3845 bp, Homo sapiens
cgaatggatagtaatttgtttgcatggggtagtatagagaagagatattaggttcacgacgatctgggagagggtgggatcagttaacattgttttgcgtgcacctcaggcttcctggctatgtgggactaaatagtaccggcattgtgggcctgtgcatactggaacttgcaacgggaccaacacgtgtaattgaagagtcagtgggaaatctagtctcttgaacaaacaacgtagaatttggaatataacggacggcctatgtgtaatatagagatagggcggcggggggtattgaatcataagttattagactgggtttgacagtaagttgaataatataactccgtctacgggaatggagttatagtaggtaaacaaaaaatagtaaggcaaagataacatcttgctcaaaaaaaaaacggggaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735738 - DNA, 3592 bp, Homo sapiens
cagcaaaaattctaaattcatcgttttaagggaatgcaaatatatgaagcattttttaagtttatgtttatactccctaccttactccaagaagaatttaaggcagttcaaatcccacttaaatttatctatcagtcataaatgcaattctcagtcagtatgtattattatccataggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735739 - DNA, 3874 bp, Homo sapiens
atgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735740 - DNA, 472 bp, Homo sapiens
tcagaggatccccttatttccttctttatgctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaggaaaataagcttattttccttctttatggcaatacggtctttcttcagtggtcccatgaatgctttcttctcctccatggtctggaagcggccatggccaaacttggaggtggtgtcaatgaacttaaggtcaatct

SEQ ID NO: 735741 - DNA, 3895 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggtaaggagcaattacagggcctctgcgtccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735742 - DNA, 3863 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735743 - DNA, 271 bp, Homo sapiens; identical to SEQ ID NO: 11667

SEQ ID NO: 735744 - DNA, 821 bp, Homo sapiens; identical to SEQ ID NO: 11666

SEQ ID NO: 735745 - DNA, 4010 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccagttgttgaaattacctccaacattcatgtcagtgattcaccactctccatgaagagctgaactggcacaagtggcaacgtatgttactgatgtaattggcacaaaactgttttcttattatctccttcactgaagccctatagccaaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735746 - DNA, 680 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaattattcataaggactagcatcttatcacaacgacaaaaatggagtgaaatctaaaacaaagcggtaaaccattcacacaaactgggaacaatacaaggaaccaggaataagaagggagaaaggcaatctctcttctaacacccttacatacgttttctgtaatctcttcccacgaaa

SEQ ID NO: 735747 - DNA, 3940 bp, Homo sapiens
actggttctgccgtcgctagaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccagttgttgaaattacctccaacattcatgtcagtgattcaccactctccatgaagagctgaactggcacaagtggcaacgttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctgaatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcagtcagttactgggagaaaaaatacagagccagtaggtttttagggatttgttttgcctttgctgctagttttttgaaaatattcttcgattatcaagattttaaaaatcggtttttaatataaagcttttttaaaaacgaggctggcacaagtgcagtggtgtttctttactcccactgcttgacttgactagccttgaaaaaataacagtaaaataaaatattaaaaaataattagaaaatgctacaaaggcaatgaccttattccattgagtaagatagttaaaaatgatagtaattgtagtgaaatagttaattacttgtaagttttattactgttaattgtagagattataaattggctcattaggtttctgaatggtgacacaataatgactgagaagagcaaaagtcagtcctcgttaactaatgtagtatgcaaattaaaatattttaatgatcagtaattttccccccagaaatgatgttggtatttctaagtaaatttcccataattttagcatagtttatgaaattgaataaaaatttattttcactgaagtaattttcttctaatatgatattattattgagattggatgcaaatctcatgaatatgttttagaagaaaattaatgaaattccctcccaggcagtatgtaccagaaggaaaactgaatttagcagtaaaacagtcctggtcattctaactacctgtatgatcttgaacaaagtcacttagtttccctgggccttggtgtctttcgtctataaaatattgtaccagattatctctgaaatcacttcaaggtttaatatatataattatcaatattttaaaattcaagcaatattcactttagaaattattataacattctataatagtaaaggttgaatttattaatataataaacacgttcaacttcttcaagcagataattgatatttggttcatattcttacaacctaatgcatgtcattttcaccaaatgcaggcagaatttatatttaggtttgcatctggaactagattatctggcactttatggccattatttttgggttgatggaccttctcaccacacaatttcccccttttttttttttgcatatcatatgttggttgatatttctcagaggtatccctatttcttcatacttaatatacatctccatttacatctttgactctctgaggtcaaaacaacaataaatgagaagtaaaacaactatatgtgtttgtatttacaactgtatctaaaattatataaccctagtttaccttcagagtaaactaggctgaagagttgttaataatgttgataaaaatgccattgaatcctttcttcaacaaatatttattgagtacctaacgtggcaaacgctgtgctaagtactggggatacagagataagtaagacacatttgcctccctgaaggacttcacagtgtagttggtaggagaaacaccagagcatacaccgttatataattagtgcagtaattgacatgaacatgagttta

SEQ ID NO: 735748 - DNA, 614 bp, Homo sapiens
gataaaaaaaaaaaaaaaaaaaaaaaaacttttttttgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaacagacatagcaagacccagattatgcacaacatgtcgtaca

SEQ ID NO: 735749 - DNA, 632 bp, Homo sapiens
  misc_feature (61)..(62): n is a, c, g, or t
cctccccccctcccgcccccgcccgtcacgtactatgcccccgcctgggtggcgaattcgnnacgagggcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaacggacgcgtgggtcgacccacgcgtccg

SEQ ID NO: 735750 - DNA, 830 bp, Homo sapiens
aaaaaacaagacaaacttaggctagtacgaggcctggtgtttaatcggccgaggggcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaacaaaccaaaaaaaacaagaaacaaacaaaagaggggggggccggactaaagaaaagtccccctcacaggagggggcgcccggcgagtagacggcgtaaccacgagtttctgtggcacagagggggcccccataaaggagaggcgaattaaaaccgataggaaactgggccgagcggttaaacaacgtcgggcgcgggggcaaacaggggtaaccggggcactctggcaaggaaccct

SEQ ID NO: 735751 - DNA, 1040 bp, Homo sapiens
  misc_feature (63)..(63): n is a, c, g, or t
  misc_feature (625)..(625): n is a, c, g, or t
  misc_feature (630)..(630): n is a, c, g, or t
  misc_feature (1039)..(1039): n is a, c, g, or t
aacacccccacccacaaactatacgtgctataaagggtactgagggccccgggtgttatcggncgagcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaaaaaaaaaactcgagantagtnctctctctctcggtgggggatgagcccttccggtgtgggcttccgtttggcaccaatcgaggtcagccctgtattttgtggacctccatcgggggggaagtgtgagctcctctcggaagaatccccggggggctcttctccccggtgagccagaccatgtcgcttgttaactagggtacccttttttgatccccttacaatgagcccgttgctgttactggtttccgtacccgggggcagagtgcgcccggcgggaaacttctggtcatggccttgctggtttggccttgaccaatggtctgtggcccgggacttgttggaccaggcgtgcccgggggggggggcccaagacggggaccacccaggttggagggggggcccctgccaactgcccgcccgctgtgcggcng

SEQ ID NO: 735752 - DNA, 841 bp, Homo sapiens
taccaccacatcacacaaccaaaagataggcataggcggagcctgggtgttaatcaggacgaggcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaacacacaacaaaaaccacaaaacaccccgcgcgcacctccacagacagaggacggcggacaaacaaagccacagaaaagggcccagggccaaaagcggcaacacgtgaccccaagcgttaccggcggcaacaagcggcggaaaaaaccagcgcgagagacccccccccacaagcggacgaccaaaatcaaaaaccgcaaaacgcccacggctaacaccgggacaaaagaaaccccgacaaaa

SEQ ID NO: 735753 - DNA, 846 bp, Homo sapiens
ccctaatccggctaaggtacgagccccggcgttgttgtaaattcggccacgcagcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaacacaacacacaaaacaatcaaacacaaacaacacaaaaccagggggacgaaccctaatcattaccacggggcgagggaaacacagaaagctccgacgacacagcggccccgagcggacacacatgtgtcaccccgcaaacccccgactagtctgcgctcccagcggggcgaagaaccctgcgcggggcacccccacatgaggagccagcataaagccgcaaaccaaccgcgtacccgcgcataacaccccacaa

SEQ ID NO: 735754 - DNA, 813 bp, Homo sapiens
aagtagttaccgggccgatcgtccagttgttagttacgtaacgaggcgcgcgtgaagtggtcttgatctgggccgtcggattccacaacgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaatacacagttttccaagaaacaaaaaaaacaacaaacaacacaacaaaaaaaaaaaaaaaaaaaccacacggaggcaacttcatatctgcgggtgccgcaaacgagtggctttgtgcactagtgcccctgtgtctccatgacggtggtacctgggacgcccccttttgtggtcccaggtgtcaaccctc

SEQ ID NO: 735755 - DNA, 777 bp, Homo sapiens
  misc_feature (603)..(603): n is a, c, g, or t
aagtcaggagggctcgcgtttacagttctacatctacatgtgccctcggcgtgttacccatttgcagacctggttcttggtctccgagacaacacgcatagaccacgcgcgagtcgtcgcgcagcagtgtagcccatccagaatggacaccactcagagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaatttcaagaactgtgtgtggccttatgtgttggtattggatgtttaaccagacagaaatcagtaaacatcctggacctataaaaaacgaanaaaacacacgagggcaacccacaccacacaaaaaaaaaactgggggcgccgggcccaaaacagtgtaaacccacttggggggcggcgcccaagagaaaagcacggcctcggggacaagagaaccgggcgcagcggggttccccaaacaagccggggacggggtggacacacggg

SEQ ID NO: 735756 - DNA, 2998 bp, Homo sapiens
  misc_feature (2806)..(2806): n is a, c, g, or t
  misc_feature (2840)..(2841): n is a, c, g, or t
  misc_feature (2843)..(2843): n is a, c, g, or t
  misc_feature (2855)..(2856): n is a, c, g, or t
  misc_feature (2998)..(2998): n is a, c, g, or t
agtgctcaaggcgcctgcgcagaccctgaaaagcggccagggtggcccctagctttccttttccggttgcggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatgggggtgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaatttgggtctgtttaaatgcttgcttgtaaaaggggttcctctgttccctttttgggactctcaatttctttggctcagaatggaaagaaaccagagtctgatttctgccccttctgaactctactacttttaaaagaaagaatatctacattgcagggtcagttaaaaaaaatttttttgagttataaggttgttttttaaaaacagtatcttgctgtcacctaccctggagtgcagtagcacaatcctaatgaactgcagccttaaactcctgagttggagatcctcccacctcagcctttcggttgccaagactacaggcacatcaccacgcctggctcatttgagaaatatttttctgtagacgtggggtctcactttattgcccaggctggtccttggtctcatgtgatccttctgcctggactgggattacaggtgtgatcaccatgcctggcctagaatttaataaaaattctgagatttcctttgtgtagcagatgttgaatgttactgttattggctgtcactgtatttgaaggatttgtatgtgtaccctctgttgagttttggggacatagcagtgatccagatgacttcaggtcttgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaattgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaacaaaaaacaaaaaaaaaaaaaccgggggcttttttgcggggggggggaaaaaggggttttggaaggggccctgggccatagtgggttccctggacccagtttttttggtccaagggggaaatttggggggcccccataaggggnggcggataaaattcgaaaagccggggtacctgtnntnttccaaaaaacnnttaacacacaaggcgcaaaataaaaggcgcacactgtaaccaaacagagacgacaaacacacaatgccactacaacactccctaccacataaacttattctcactcaaatatgtctcatactataacagtaacaacatgaan

SEQ ID NO: 735757 - DNA, 2900 bp, Homo sapiens
  misc_feature (2759)..(2761): n is a, c, g, or t
  misc_feature (2839)..(2840): n is a, c, g, or t
  misc_feature (2843)..(2844): n is a, c, g, or t
  misc_feature (2854)..(2854): n is a, c, g, or t
  misc_feature (2859)..(2859): n is a, c, g, or t
  misc_feature (2872)..(2873): n is a, c, g, or t
  misc_feature (2875)..(2875): n is a, c, g, or t
  misc_feature (2888)..(2888): n is a, c, g, or t
  misc_feature (2895)..(2895): n is a, c, g, or t
agtgctcaaggcgcctgcgcagaccctgaaaagcggccagggtggcccctagctttccttttccggttgcggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatgggggtgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaatttgggtctgtttaaatgcttgcttgtaaaaggggttcctctgttccctttttgggactctcaatttctttggctcagaatggaaagaaaccagagtctgatttctgccccttctgaactctactacttttaaaagaaagaatatctacattgcagggtcagttaaaaaaaatttttttgagttataaggttgttttttaaaaacagtatcttgctgtcacctaccctggagtgcagtagcacaatcctaatgaactgcagccttaaactcctgagttggagatcctcccacctcagcctttcggttgccaagactacaggcacatcaccacgcctggctcatttgagaaatatttttctgtagacgtggggtctcactttattgcccaggctggtccttggtctcatgtgatccttctgcctggactgggattacaggtgtgatcaccatgcctggcctagaatttaataaaaattctgagatttcctttgtgtagcagatgttgaatgttactgttattggctgtcactgtatttgaaggatttgtatgtgtaccctctgttgagttttggggacatagcagtgatccagatgacttcaggtcttgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaattgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnaaaaaaaaaaaaaaaaaaaaaaaaaaaaccccggggggccatttttggggggggggaaaaaagggtttataaaggggnnggnngaaaaggttncgcgncccctttttttgnncnaagggggaaaatnggggggnccccc

SEQ ID NO: 735758 - DNA, 2827 bp, Homo sapiens
  misc_feature (2666)..(2666): n is a, c, g, or t
  misc_feature (2669)..(2669): n is a, c, g, or t
  misc_feature (2680)..(2680): n is a, c, g, or t
  misc_feature (2766)..(2767): n is a, c, g, or t
  misc_feature (2770)..(2771): n is a, c, g, or t
  misc_feature (2781)..(2781): n is a, c, g, or t
  misc_feature (2786)..(2786): n is a, c, g, or t
  misc_feature (2799)..(2800): n is a, c, g, or t
  misc_feature (2802)..(2802): n is a, c, g, or t
  misc_feature (2815)..(2815): n is a, c, g, or t
  misc_feature (2822)..(2822): n is a, c, g, or t
agtgctcaaggcgcctgcgcagaccctgaaaagcggccagggtggcccctagctttccttttccggttgcggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaaggtgctgggatccggcaccggcgttgagtggatggaggactcttggagacagagatgttgtagctcttgaaagctgggggggctggcatcagcaacgggatgtttagaagttgtgttgggtgtagaacagtggggtatttggcaatagagctgggcttggggttcagaagatgtaaaagctgagatgggggtgttgaagattaagggtttgctttgagaactgggatgttaggaagctcacctcactggggcggggggacccaaagggtgaagggacaccgactattttttattttatttatttgttttgagagggagtctcgctgtgtcgcccaggctggagtgtagtggcgcgatctcggatcactgcaaccttcgcctcccgggttaaagcgattctcctgcctcagcctcttgagtagctgagattacaggcatgcaccaccacgcccggctaatttttgtatttttagtagagacggggtttcgccatattggccagagtggtctcgaactcattacctcaggtgatccaccagcctcggcctcccgaagtgctgggattgcaggcgtcagccaccgtgtgcggccgaatttgggtctgtttaaatgcttgcttgtaaaaggggttcctctgttccctttttgggactctcaatttctttggctcagaatggaaagaaaccagagtctgatttctgccccttctgaactctactacttttaaaagaaagaatatctacattgcagggtcagttaaaaaaaatttttttgagttataaggttgttttttaaaaacagtatcttgctgtcacctaccctggagtgcagtagcacaatcctaatgaactgcagccttaaactcctgagttggagatcctcccacctcagcctttcggttgccaagactacaggcacatcaccacgcctggctcatttgagaaatatttttctgtagacgtggggtctcactttattgcccaggctggtccttggtctcatgtgatccttctgcctggactgggattacaggtgtgatcaccatgcctggcctagaatttaataaaaattctgagatttcctttgtgtagcagatgttgaatgttactgttattggctgtcactgtatttgaaggatttgtatgtgtaccctctgttgagttttggggacatagcagtgatccagatgacttcaggtcttgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaacctgtgaggctcaaagaaagggcagagagctcaggtgggaaatagaaaaggcacctgaacagtccagggatggctttcgactacttgaaacagccttgggagtttcagaagctattggaatgctccttactgttcagccttctaagaaccagtcttagaggtagggtgtctgaggtccagtgagggacacaagtaggagggagcccagatcttgttccctttaccttgcctatatttcttaacaccacttcagcagtctcatatctggcttttttgactttcctcttctctgggtctgtagagggccttggagtgacaccctgacccccatccactagtacttgaaggccagtggtggcagaagccacagaaacaagaagcccagtgagatggctaagctgcccagcatgtaacttaaatccctgttcattccccattcctttagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaattgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaanaanaaaaaaaaaanaaaaaaaaaaaaaaaaaaaaaaaaaaaaaaaaaaaaccccggggggccatttttggggggggggaaaaaagggtttataaaggggnnggnngaaaaggttncgcgncccctttttttgnncnaagggggaaaatnggggggnccccc

SEQ ID NO: 735759 - DNA, 531 bp, Homo sapiens
aggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaaga

SEQ ID NO: 735760 - DNA, 1395 bp, Homo sapiens
ggccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttcccattccaccccgcgctcccctcaattaggaggagaaaccgcacaagctaccaaatatataaaaggcattgattcccggagcaaagggaggggagggggcccgggtaatgtacatagctgttcaagttaaggtttagtttccttccttcccctctgacccctaagctttcacttttcctttagcttccctttcctccccattcccaccctcagccgggctcaggcaatagtatattataaagaaaatgtctacattaagcaccaggactgcaagaggccatagagaatagtccccggaaagtgtttatgacaggtacccctcgccagtccgcccatttctcaccctttggttaaccattacattttccaggacagagcatttaatttactttttaaaatgaccctcgctggccgagcataagtacgttaaaatctttaaatgagttttttttaaaaagctaacgctttcattccctgccccgcccccacccgtacacctttgacttgtgacattttcaggatttacaaaggatctgggagctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaagtattaggtgatgtgcagtactgaaagtgcagtatctaaccaactagaacgtttgttttatttttagaacaagtgcacctttgttatatatttagtatattggtaccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacacgctttattttttcttttgcaaataatagaaaaaacacaaccacagaaacaaacaaataatggatgtgcaagaatgccatctattaaaaacatggttaatatttaaaaaaaaaa

SEQ ID NO: 735761 - DNA, 479 bp, Homo sapiens
atgaaatattctttttccattagatttgttcttatgtggacatagatatctacagtcattacattagccttagaatttagcatcatacttttaagcaccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaaaaaaaaaggggggtaatataggagggcagtagtcagttgaagggccaaagggttaaaaagggggacgggggaagcgggtgtgacactgggggatggacccacaacgaaaaagtgacgtggagtaaaaaaaacgaagtaatctatc

SEQ ID NO: 735762 - DNA, 4838 bp, Homo sapiens
ttgaataaatttctcaaatagaactgtgcaaaccctagcactttatgtgttgctgcctccccatacctaggtatgctctgtaataagctcccatttaatggagagatgtgtggaggcactgagaagttaatgaagaaaaatcaaccctaagaattccttattgtcacatagtgtcttttaaaaaataactgtagagactgtgttaattcgagtgcctttcttacttttttgggagcaagattatatttaatgtttaagaaaacaggatggaagttttatcaaacagttgattgtggcccattgttttatttattcccatcgctaggcatggccccgtagggtattttatccttcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgtccaaagggaaacagtggcactctgccctaaaataaaggccagaacgttgtcctaaatgaatcctttgccttactttaggaccttccttccctctcaaattcaggcataatgtaatatagttgaaagggggaaaacagtacttgctttctctcaggtattggaggaaaagaagtaaatgcgtagatgaaattttaaatgtatcattttatctgtttgtatatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaaaaaaaaaggggggtaatataggagggcagtagtcagttgaagggccaaagggttaaaaagggggacgggggaagcgggtgtgacactgggggatggacccacaacgaaaaagtgacgtggagtaaaaaaaacgaagtaatctatc

SEQ ID NO: 735763 - DNA, 4705 bp, Homo sapiens
ttgaataaatttctcaaatagaactgtgcaaaccctagcactttatgtgttgctgcctccccatacctaggtatgctctgtaataagctcccatttaatggagagatgtgtggaggcactgagaagttaatgaagaaaaatcaaccctaagaattccttattgtcacatagtgtcttttaaaaaataactgtagagactgtgttaattcgagtgcctttcttacttttttgggagcaagattatatttaatgtttaagaaaacaggatggaagttttatcaaacagttgattgtggcccattgttttatttattcccatcgctaggcatggccccgtagggtattttatccttcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgtccaaagggaaacagtggcactctgccctaaaataaaggccagaacgttgtcctaaatgaatcctttgccttactttaggaccttccttccctctcaaattcaggcataatgtaatatagttgaaagggggaaaacagtacttgctttctctcaggtattggaggaaaagaagtaaatgcgtagatgaaattttaaatgtatcattttatctgtttgtatatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtataaagcgctttatacaatactgatagttattttatccacgtacaataaatcactcatttaattaaatagttttataaaagaaacatatttataaa

SEQ ID NO: 735764 - DNA, 4786 bp, Homo sapiens
ttgaataaatttctcaaatagaactgtgcaaaccctagcactttatgtgttgctgcctccccatacctaggtatgctctgtaataagctcccatttaatggagagatgtgtggaggcactgagaagttaatgaagaaaaatcaaccctaagaattccttattgtcacatagtgtcttttaaaaaataactgtagagactgtgttaattcgagtgcctttcttacttttttgggagcaagattatatttaatgtttaagaaaacaggatggaagttttatcaaacagttgattgtggcccattgttttatttattcccatcgctaggcatggccccgtagggtattttatccttcagtgagagactgatataagcaggcaggatgctttgattattccattagttatcattttaagcaccctaccaagatttagttctttctttctggcaactaacgttttgggggttggaggcatcccatttagaggatggtgtgtgcacaaatagattagcctgaaacctgcgtccaaagggaaacagtggcactctgccctaaaataaaggccagaacgttgtcctaaatgaatcctttgccttactttaggaccttccttccctctcaaattcaggcataatgtaatatagttgaaagggggaaaacagtacttgctttctctcaggtattggaggaaaagaagtaaatgcgtagatgaaattttaaatgtatcattttatctgtttgtatatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtggcaaaaagaaaaggcaaaaatatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaaaaaaaaaggggggtaatataggagggcagtagtcagttgaagggccaaagggttaaaaagggggacgggggaagcgggtgtgacactgggggatggacccacaacgaaaaagtgacgtggagtaaaaaaaacgaagtaatctatc

SEQ ID NO: 735765 - DNA, 732 bp, Homo sapiens
tatatttccaacaaaagaagcactgtaatacaaaaaagattattaaatatttttagttagtgcttttcatgagaggttgccaaagaaaaatatacactttaaaaatgctggcactttagtgatttttttacaaagtattttgtgtaaggttacttcagcagtagagataggactaaaatcctgtatattatcacaattgatctccatgcattcaattgacagtcacaatggaagcaattatattcaaattatgaagaaaatacataccaaacttctataattacttaaccttgaggctagcctagagatatttaaaacaaaaaatctgttaggctgttattaacatatagaaagataaattctaactagcttaaataaacccagtctttttttgttgtttccagtttttgttttgtttgttttttgagacagagtctcactgtcactcaggctagagtccagtagtgtcatcatggtttactgcagcatcaaattgctgggctcaagcaatccttctgcctcagcctcctgagtagctggccccacaggtgcatgcccacatattggctaattttatttttaagattttttgtagaaacaaggctatgttgcccaggctggcctcaaattcatgggctcaagcgattcttctgccttggcttcctaaagtgttgggattacaggaatgagccactgcacctggccaacccagtatttcatgctagaatatgg

SEQ ID NO: 735766 - DNA, 1212 bp, Homo sapiens
gagagtgcaggcgctgaggacagcgacgatcccgagacgagacccaacggcgagaaaggagagagcaagagatgccatggactacaaggtgatgaataccactatgagctcactacaagatctcaaagatttcaagccactggctgttacaaagcataaagccacccttctggagcagcggcgggaggcaggctgggaggaggccccaagttttggccagacgatagaccacctccttaggtgtccggggagctgctgaaacataatgaggaagatgctgctgatccaaaggataaaaacacagaaactagaaccaagaagcacctaaagtggactcatgcccagcatccctgcagactgactttctctgagctatagttctgcattggactgtttttcctttgctatcacctgcccaacacacaatcctggatgcttttgattggttggatttctttttttttttcctgccttttctttttctttccttgaccctgggaattataaacgagaaattgctttaaaaagtattgttctgtgctaaaattagccttgtttatgaacaagttttatccctagggatttcctgaattgcaatcccagattaccttgtaaatggggctgtgttgtttgatttgtatagtactgatctgtaggttaaaatacgtttcctttcttttgtttcattctttttttaaaagtctggatccaggtaatggcctgagtcacatttgcttagctactgaagcgatctcaatatgttatcgcttagagttgaaacataatcaaacatacgttatacctggggctcttgcacactatttgatatatatatgttactctacaaagaaacacaaaccttgtatgttgaaatgtaattcctgtttgatcctgcagctagaatgctaaagaaattgcaaatatcaaaagtgacttcaaataccctgaatataagctagtcaacagtaagtggatggttccagaataccatattctaagacaaagcaggaattagagatcaactgacctcatccataatgttgctcaggtctgtctgtggatctgtccattttggagtaaaaaacaaggcatgcttctgtgattgtgtttatgaaaactgtagtatttcagatttatgttttgcaattgtgcctgccttgcaataaaacaccttcagttgactcagcaataaggtctctgtcaatttcctgc

SEQ ID NO: 735767 - DNA, 307 bp, Homo sapiens
tgcttaatgtgattttgagaggagcagaaggtcgaaatctcattgatgaagattccactattacagagcagttgttgctgttattaacttagcgttaagacaacatttttcagagcacgaatcaatcatcattaatctttctcatgcaccttcttcatagatgcaagaagaaggttccagccagcaagcgcttcaccatccacagaacatccaacgtcttaaccctttccctcaagcgctttgccaacttcagcggggggaagatcaccaaggtgagcgctcgtgacaccatcccaggcagctccgt

SEQ ID NO: 735768 - DNA, 230 bp, Homo sapiens
gaccccatgcttcacgacgacataccaacgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaagctcaagcatgcgggatcctctagat

SEQ ID NO: 735769 - DNA, 1365 bp, Homo sapiens
  misc_feature (165)..(165): n is a, c, g, or t
cattggtgtgaatcagagtcctccccaccttccaggaaatgcagagtagggcactgggcttcctcctgggcaccataagccccgaagctgcaccggcctccactactccctgggcccagtcctcagcctccaagccctccgaggagctctcctcatcttcctccncactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccaggtaagctttgggccgggatcttctgggtgccaactggttctccctgtggttgcgtgtgcttggctggtgaggagttggacgaatcgccaacctcacaggacagacaaagcattggggcagccaggaggtacaggggggcgtcactgaccaagatccccctcttctgtgttcccctgtggtaaaggagctttgggtggtgaaggcagttcggcctctgcagtcctgatgtcttagttctgtctttgttggtggtctgtctgcgacatccttgtggtgatgtggtgtgctggggactgacctgtcctgtatccctaccagccccatgacagtacttcccagtcgaagagaaaggcgaagtgaggccttggcgagaggct

SEQ ID NO: 735770 - DNA, 357 bp, Homo sapiens; identical to SEQ ID NO: 333800

SEQ ID NO: 735771 - DNA, 452 bp, Homo sapiens
tttaaaccctcagccgtggcacgaaggtggcttctgtccgtggcaggatccagaacagctgcttctgagggttggggcagggtgaggagccccacacatgctgtgtcttgggtagggaaggggcagagtgacgaagctcttccaacctgggtaatgtcacttcttgctcagagcatgtttttattcagacttcgagaccaaacatgacatctttgttcctcagacgagggcatgggtttagaaagaactgaactctttggctgtggtttagggtttagctaagagggcatcgctgggggttccatgctgaccgaccacacatgggcgtcgagccgtcctcctcttgtccttctcttcaccacaaggtggcactcaaaattgttgactaattatgagtagactagttggtaaatgacactcttgaagtgaagccacaggggacctgggaacct

SEQ ID NO: 735772 - DNA, 494 bp, Homo sapiens
aaggacacaagtcctgtttgattaggtcccaccctaatgatctcatgttaacttgattacatctgcaaagaccccacttccaaataaggtcaccattcacaggtactggggcttaggacttcaacatatcttttgttgggacatgactcaacccataacagtatggaaaggttctcttctcagagttaaatgtggctcccaatctctacctcacagatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 735773 - DNA, 6084 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 735774 - DNA, 5981 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 735775 - DNA, 5763 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 735776 - DNA, 4974 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 735777 - DNA, 4236 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgtgctgggagcctgtcacgaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggatttgacactgttgacctccgcaccctggagagctcctctaagatgtgagcctgttgcatttgctgcatactctagatcaagcccagaatcaactgatccagtcaatacatcccactgaacagccgaccgatccaccctctgtcaggatctctactgtagacactgaaagaggtgccccctcagtataggatcctggcctcaaataatcttctcgcc

SEQ ID NO: 735778 - DNA, 5958 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtgaaaaaaaa

SEQ ID NO: 735779 - DNA, 4095 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgtgctgggagcctgtcacgatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 735780 - DNA, 3863 bp, Homo sapiens
ctttcggagttagcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 735781 - DNA, 746 bp, Homo sapiens
  misc_feature (538)..(538): n is a, c, g, or t
aacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaanatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtga

SEQ ID NO: 735782 - DNA, 901 bp, Homo sapiens
  misc_feature (823)..(823): n is a, c, g, or t
  misc_feature (826)..(826): n is a, c, g, or t
  misc_feature (844)..(844): n is a, c, g, or t
gtcttccttctataagatttatttttagtaattctaacaattatcataaaaataatgtatttagtaagcaaatacgatgtgccagatgcctttccaagtatttatattctatattaactagtttaatcttcactatagcatcataatagtgacaacagtaaaaatgtgccatggctaaaggctttccctctcattacattaagagtctctcaccatggtgaaatctttgatgttgactaagttgatagcaatgactaaaggccttaccacattctttgcatttctgtggtttcacaccagtatgaattgtctcatgttgagtaagtcgatcactgcgattaaaggccttatcacattctttacattcatagggtttttcaccagtatgaattctcttatgttgagaaagacctgagatagaacgaaaggccttcttacattctttacatacatagggtttcaaaccagtatgaattgtctgatgataaattagttgagaattaagtctaaaggtttttccacattccttacattcatagggtttctccccagcatgaattgattgatgtgtcttaaggtctccaacacgactgaaggctttcccacattgcttacattcatatggcttcaaatcagtatgaattatctgatgttgaataagatatgaatgaagcttaaaagtcttcccacattctttacattcatgtggcttctcaccagtatgaattctctgatgctgtgtaagttgagagcctctacaaaaggcctttccacaatccttacaatcatagagtttctcactactatgaattctcttatgttnaanaaggcttgagcccttacnaaaagcctttccacattccatgcattcatgaggtttctcaccagtatgacttctttg

SEQ ID NO: 735783 - DNA, 589 bp, Homo sapiens
tatgattgatatatagtattacaaaatgtagaggataaagcaactgaaacagctgtaatttttataaatgaatacattttatactagtgaatttactattcttaatgagtaagttataatcaaatgacttctgtctgtggataaataggtcattcttctctatgttctattgtgaagactaaaagtgttagattagtaaagtaagttctgaaaaagataaagagttggaatatgataagcatattcattttggtgttgcttttcaatttgtaggaagaaccaatagaacggcttagtgttcctgatatacccaaagaacattttggtcaaagacttcttgtaaaatgcttatcactcaagtgagtatttatttcttttacttacaacttttattttccaggataaaattttagtagtgatgtaacaaaatctgagtagattttatagttgcatttgtgtccttttgagaagtattgttctacatgtcattttaaatactattcagcattcaaacgtatgtatgaagctgagcctactgtgctaagcctaacgtatttatgaagctaagcctactgtgtagcaaacataa

SEQ ID NO: 735784 - DNA, 2623 bp, Homo sapiens
  misc_feature (2249)..(2249): n is a, c, g, or t
agccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagatggtttatgttccaaacactacttacagaaatcttctctacatataccctcagagtcttaattttgccaatcgtcaaggttctgctagaaatataacagtgaaagtccagtttatgtatgggagaggatccaagcaatgccatgccgagccccagctggcacccatcctattaccgacagttaggacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatggaaaatacaatgtttttatgtatgnaaatggccgatttgaaagagtatataaacatagacatactgtgtttgcccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgttttaaaaaaaaaa

SEQ ID NO: 735785 - DNA, 1955 bp, Homo sapiens
agccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagatggtttatgttccaaacactacttacagaaatcttctctacatataccctcagagtcttaattttgccaatcgtcaaggttctgctagaaatataacagtgaaagtccagtttatgtatgggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaa

SEQ ID NO: 735786 - DNA, 2005 bp, Homo sapiens
tcgggagccttcagggatgcgctgccagctgcgcccgggcgtttctccggacctgttgtgccagatcggaaagcgggttggctgtgcgcgggaccaagggggtggccttcggggagaacccccgagccgcaggcacctgctcccagtcccccttcttcccggtggctccacctcccggtgtaaggctttgggttctgtgccctgacaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattggggaacctgtcaagaagtgctttatccagagaagcaaattttgcacgattgggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaac

SEQ ID NO: 735787 - DNA, 1893 bp, Homo sapiens
atctcctgtttttggtgatggcggcggccgtggtacggtccggattattcgagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattggggaacctgtcaagaagtgctttatccagagaagcaaattttgcacgattgggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaac

SEQ ID NO: 735788 - DNA, 1878 bp, Homo sapiens
ccgacagctcccactcgcctcattttctctaagcagagcaacttcgcggacagcggagctcgcccagcatggatgttccaggttcacaggcgcctttcttctgagaacgaccctggccttgaacgtcagagccggggacgaaggcccccggaggctgctgcgagctccgcgcgttccttcgcgcccttccgcgccgctcgcgccggcgccggcctccacccccgcgcgccgcctcccaccagtcccgatgcaggcgcccggccgggggccactcgggctgcggctgatgatgcccgggcgccggggggcgctgcgcgagccgggcggctgcggatcctgcctgggggtggcgctggccctgctgttgctgctactgcccgcctgctgccccgtgcgggcgcagaacgacacggagcccatcgtgctggagggcaagtgcctggtggtgtgcgactccagcccgtcggcggacggcgccgtcacctcctccctaggcatctccgtgcgctccggcagcgccaaggtggccttctccgccacgcggagcaccaaccacgagccgtccgagatgagcaaccgcaccatgaccatctatttcgaccaggtattagtaaatattggcaaccactttgatcttgcttccagtatatttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagccccctagatggtgggggaatggcaaactggacccaggactccgccctttaaaacaccctgaacttactggaattggacaccttgtttccaacctccgtcagactgttgcagtagaagaatgatttcctttgaaacctccagtacttttgtttttgttttttggaatactgacaattcctcgggaacctggcctctaattagttttagatgacaaggtcttaaggagaaatgaaattatcgatttgagcaatttgtacctgtgattgtaaagtcaatatcggattttattgttgggaccatggacctcttttgtttgtatgttgtattgtcgtcccaacggaaggagagctcctgactccaggatgggctgcaggttgcagtcagggcttgaagtaggagcccagcaaagaaccacctgctggacagtccttgacatgtgttctgtgtgtgtctgtatagccttaagaaaaagaatggcttcactttcattctgtattcttccccccaccatgtggctgggaggacttgggagggggatggggacattggggaacctgtcaagaagtgctttatccagagaagcaaattttgcacgattgggactgcaatttttgttttgtattgtttgtgttttttcttgaaaagctttacttttctttccacactcagctctccctcctcaaccccacttttatttttcttgctggggttgaggagagaaaatatagaattcctggataagaccaaacaaaacaaaacattaaaatacctgtatgttttgttttagacgagaccaaactaaacaaaaagtatctgtttatcaaagtaaaagtaacacaatggacaattctgcttattctctcaaagagattctaagatgcacctttagaactattaatagcaacctgcatttttttttaatttatacttcagaatcctttaagaac

SEQ ID NO: 735789 - DNA, 1896 bp, Homo sapiens
aatattccagaaatttactggctacagacagggatagtggtgaaggaaccatcctaaacagagtaaatgcagaagttactgtacagaaaggaacatgcagaacacatccaccaacgctctcccaccctctcccttctcccacaagcaccacacagagtgactcgagaaaagcaaaaaagaaaaaaaggaaaataatcagtcaactgaaaaacgcaaagaattctcccccactgagtttctaacacaagttactgatcaagtgagaaaaggctgtactttggctctttcctttctttctaaaatacacagtatttgaaattcctggttgaaaaacacagtagatgacagccactgaggtcaactggggcccacattatcccgctcagctgcctgcctagctcttcaaaactgcgtatctcagtcatttccgatgcccacaaaagcacaaacaatgcacaaaatcagggtaatccaattccactagagagctcccggcagcccgtggcaggcctgaaggtctctgggcagctagtaccagcagaggcaagcccaggtagggcagccacatagaactgggacatacttacactaggaacttcttcactgtttatccaaaatgcaaacttaattgagtgtcctatatttttatttgctaagtctgacccggatgaaggggccttacctgcaggccataaagcccctgggtgccacctgaaagcctgcctaggccaggtctgctgaggccaccaaagcatatgtcctgatgctgaagtcccctctgggatcactgactccccacttcctgttcaaacagaagccagtgtctggggcaaacttttttggccctccccatcccccaagaaatagaagctcaagggcaaaggcagccaggtgtacagattgtgctagcgcagagctgggtttctgccagcaccccgtccctttttctttttaaagatccggccttcattattcacagtacatcaaatttccacccccttctcaatgtttccctgctgctgtgcagctctgcaagtttctgtctttgaaggaacagccctgagtctcatttgatcctgggagacattattctcctccaccttctttcagactgaatgcctattaagggcccccacggtgaatcacggagtctgaatctaggcacgtggagctgatccagaggatgtggggaggagcctggcacaggaggacaaagcaaagcatctgctcattcaaatatctgctgagcaatctactgtgggccagataccccagagagggcacacaggagaagcatatttcaaaaaccaaggttaggacaggaaaatatcctctttccctgggttagcaacttagaaccacgagtacttcacttaggtgatcctggacaaaaaaacgaaaaaaacgagcctacttttaaagaattatgcacaactctgggaacaaatcagtgcttaatttacctcagatattccagctacctagcacggcccagcacacaaagaggttttgaaatcatctgctgcaatggaatcttggctgataaatacacgtggcctatctagccagtcacaagttatgtgcgtaacaaggcaaaaaagcagcacagaccacttgaaatctcttttcagaacactttagtaatttttaacttttttccttttcggttggaaacaagtggcagaaagatttatttccttcctgtccctgccctgtgagggataccaatatattatggaactgtcagaagatggtggaagatgggaagacttgtggattcagcgtaggataaagaatgggggatattttcttccacagtttagacaactcctgtttaatgagatgctgacttcttcctggtatttctgagatgcaggaacaaaagctcaattctga

SEQ ID NO: 735790 - DNA, 1477 bp, Homo sapiens
ggagataaagataataaactcaatctacagtaagaatagaataaggaaatattatattaaataatagagctcccggcagcccgtggcaggcctgaaggtctctgggcagctagtaccagcagaggcaagcccaggtagggcagccacatagaactgggacatacttacactaggaacttcttcactgtttatccaaaatgcaaacttaattgagtgtcctatatttttatttgctaagtctgacccggatgaaggggccttacctgcaggccataaagcccctgggtgccacctgaaagcctgcctaggccaggtctgctgaggccaccaaagcatatgtcctgatgctgaagtcccctctgggatcactgactccccacttcctgttcaaacagaagccagtgtctggggcaaacttttttggccctccccatcccccaagaaatagaagctcaagggcaaaggcagccaggtgtacagattgtgctagcgcagagctgggtttctgccagcaccccgtccctttttctttttaaagatccggccttcattattcacagtacatcaaatttccacccccttctcaatgtttccctgctgctgtgcagctctgcaagtttctgtctttgaaggaacagccctgagtctcatttgatcctgggagacattattctcctccaccttctttcagactgaatgcctattaagggcccccacggtgaatcacggagtctgaatctaggcacgtggagctgatccagaggatgtggggaggagcctggcacaggaggacaaagcaaagcatctgctcattcaaatatctgctgagcaatctactgtgggccagataccccagagagggcacacaggagaagcatatttcaaaaaccaaggttaggacaggaaaatatcctctttccctgggttagcaacttagaaccacgagtacttcacttaggtgatcctggacaaaaaaacgaaaaaaacgagcctacttttaaagaattatgcacaactctgggaacaaatcagtgcttaatttacctcagatattccagctacctagcacggcccagcacacaaagaggttttgaaatcatctgctgcaatggaatcttggctgataaatacacgtggcctatctagccagtcacaagttatgtgcgtaacaaggcaaaaaagcagcacagaccacttgaaatctcttttcagaacactttagtaatttttaacttttttccttttcggttggaaacaagtggcagaaagatttatttccttcctgtccctgccctgtgagggataccaatatattatggaactgtcagaagatggtggaagatgggaagacttgtggattcagcgtaggataaagaatgggggatattttcttccacagtttagacaactcctgtttaatgagatgctgacttcttcctggtatttctgagatgcaggaacaaaagctcaattctga

SEQ ID NO: 735791 - DNA, 1105 bp, Homo sapiens
tcccttcacccgcggctgcctcctgcccccatgactacagtgtgatgctgtctgggaagctgaatgtcatcttccctgggcttacctgccaggctcctctcatccacatcttccagcctctagccacatggacccctccggaaagcatgtgtgtgtggggggtatgtgtgaacatttttcatgcttgatgtgagccggaagaaaaatgagcttctctatttgataagtgtggacctgcccacagcactaaatttggttctgccgtcaccggcgccatgaagcagcagcctggtttagaggcttgcctttggtttcaaataatttctccaggctcatgttacatatgacccattcacagaggctggagggcatggcttctccagtccttagcactaaagacgtgtcttttggctcctgcacgactagcacaggcagtagaaccagatgggggatgctctgaggttgcagaggcaggaaggcaagcgggagagagcttgggcctggacagagggatgagctggctccctccccagctgtgaaatctctgagtctcagtttgcttctctgcaaaatgaggataataatccccacctcgggactgaggattaacgaggcaatggttttagcagaataatccactgctgctattattatcagcatcttcgtatagcaaaactcatttggaccaatggggagtgcgttaagttggtctgaagtagggcaaaggaacgattatagaatgtttcaaaggaaatgtgttttttattatttccatgtatatagagtactggaactgagtgctaggaggtggagaactgacttgatttaaataaggagagctcatttgacattggcctgtttgatttctcaacatccaactgtgttaataaagagggttttgagctatctatgtgcccagctctgtgactggagaaggaaagtcacataagacacagtccttgccctcacaggacgtgcaacctgtgggcagatgagtcctacacaggaagcgggggcaagaaggaaactgtgaggcactggggagcacggcgctgccacaggtgagaggaaacgcgtagcctctggaccttgagtgccaaggctg

SEQ ID NO: 735792 - DNA, 6609 bp, Homo sapiens
gggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttggttccacctactccccaaggtcttaccctccccaggatggagccccaggaaaccaggtcctggcagtccctcttgagatgccagaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 735793 - DNA, 1341 bp, Homo sapiens
tggaccggtccggaattcccttgacatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 735794 - DNA, 1311 bp, Homo sapiens
ctgcctggcatgtttaaaagaaaatagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 735795 - DNA, 1043 bp, Homo sapiens; identical to SEQ ID NO: 414823

SEQ ID NO: 735796 - DNA, 6307 bp, Homo sapiens
gggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttggttccacctactccccaaggtcttaccctccccaggatggagccccaggaaaccaggtcctggcagtccctcttgagatgccagaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatgatgagtggccaactctggagcccaggatgttgcttcccagtctggtggtgaatcctccacaatctgagctggccctctggtgcccaaagcagactcctggggtccctgtattgggcacttacccacttcctgctggccgcagcatgacacctgatgctcctagagcagccaactgaattccagaagaaaggcttcagtggtgtgttttccagaaggaacctggctcctaggattaacagttgggtcaaatctcaaaaactctttgcccttaactgctgaaaactgccagcatctatagcagtcatagtcacaagatttcctttaaatttttcagcaattgttttcctaaggcattctgtaaagtctggcttgaagtttgtttagttgagataaaaatgtgtttgactgcactccagcctgagagacagagtgacatattgtctcaaaaataaataaacaaataagttttttaaaacatgtttgagaaccac

SEQ ID NO: 735797 - DNA, 5817 bp, Homo sapiens
  misc_feature (5758)..(5758): n is a, c, g, or t
  misc_feature (5760)..(5760): n is a, c, g, or t
  misc_feature (5764)..(5764): n is a, c, g, or t
  misc_feature (5780)..(5780): n is a, c, g, or t
  misc_feature (5784)..(5784): n is a, c, g, or t
  misc_feature (5786)..(5787): n is a, c, g, or t
  misc_feature (5791)..(5791): n is a, c, g, or t
  misc_feature (5802)..(5802): n is a, c, g, or t
gggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttggttccacctactccccaaggtcttaccctccccaggatggagccccaggaaaccaggtcctggcagtccctcttgagatgccagaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcctggaaggcctgccatngnatgntctggatttctgccancccntnnttgntcacgtgcgtncccactacgctcttg

SEQ ID NO: 735798 - DNA, 6555 bp, Homo sapiens
gggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttggttccacctactccccaaggtcttaccctccccaggatggagccccaggaaaccaggtcctggcagtccctcttgagatgccagaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaactgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 735799 - DNA, 7058 bp, Homo sapiens
tactttccccattgttcaagatgtgttttctcaggcatctccgtgccctggcttgtcattcagccagcatgtgagagaagactcaacaagatcagaaaccaaggaagaagaaatcaccagtctcttcccaggggatccagggacagggctgtcgtcactcatggcctttttcactttctttagttccacctactccccaaggtcttaccctccccaggatggagccccaggaaaccaggtcctggcagtccctcttgagatgccagagctaggtgagctgtgcttccctctgccttgcttgggattctctcaccgctccctgaatctggcctcagcctctgtctcttgccccagcatgacacacggcagagtatgaaccccagctgctgccttcctaccctccctctgcttctcttctggaggctgccaaggattggatgtccactgggcttggagttccaatcatccaggtggggaagctgagtttccatccaggaaagtgattgaatggaggtcccttggaaagacgagaggccaggtccatggcccagggatcctagtgcttgatcaggttctcttttcaggacttcttggagctgtggttaggcctccatgttagcaacagacacccactccagaccctcacctcttgaccctggcattactggcgctgcccctgcctcattctaaaatagatggaaagactgatgagccctgggaattctttcaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagttcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacgtgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggcaaaaaaaaa

SEQ ID NO: 735800 - DNA, 167 bp, Homo sapiens
tcgaattcaagcttctaacgatgtacggggacattcttcatgggggtaagaaaagctggtctggagttgctgaatgttgcattaattgtgctgtttgcttgtagttgaataaaaatagaaacctgaatgaagaataaaaatagaaacctgaatgaaaaaacaaagac

SEQ ID NO: 735801 - DNA, 165 bp, Homo sapiens
gatcagggatcatcgagctcagtctgctcgtatcttcatgggggtaagaaaagctggtctggagttgctgaatgttgcattaattgtgctgtttgcttgtagttgaataaaaatagaaacctgaatgaagaataaaaatagaaacctgaatgaaaaaacaaagac

SEQ ID NO: 735802 - DNA, 180 bp, Homo sapiens
gagaagacgacagaaggggaagaacgtgggatctaagatgattaggatcttcatgggggtaagaaaagctggtctggagttgctgaatgttgcattaattgtgctgtttgcttgtagttgaataaaaatagaaacctgaatgaagaataaaaatagaaacctgaatgaaaaaacaaagac

SEQ ID NO: 735803 - DNA, 617 bp, Homo sapiens
ttaaaccttccttaaagattctttgatgctttgctcctgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaataaaaatagaaacctgaatgaaaaaacaaagac

SEQ ID NO: 735804 - DNA, 962 bp, Homo sapiens
  misc_feature (877)..(877): n is a, c, g, or t
  misc_feature (901)..(901): n is a, c, g, or t
aaataggctagtagaggctgggtgtgaatcggccgagggcgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgccttacccccccgtttgttggcccatggcnccctgggggtgggcggcgggggcncatttttgaagccccgttttaactggggggcacgtctcttggcccaactttggtgcgacaa

SEQ ID NO: 735805 - DNA, 1495 bp, Homo sapiens
gctggtacggtcaggagattaggggcgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaataaaaatagaaacctgaatgaaaaaacaaagac

SEQ ID NO: 735806 - DNA, 940 bp, Homo sapiens
  misc_feature (1)..(1): n is a, c, g, or t
naacttatggctaggtacgaggctgggtggtgcccgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttataggtcgagcccattggacttcttggggggattgggccgggggggcccattttctctggct

SEQ ID NO: 735807 - DNA, 394 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtttacaaactggaatcaccaggtggcgctctcggccctgaacagaatctgggttccacagccaaggtcatctcagggataatagttggtg

SEQ ID NO: 735808 - DNA, 517 bp, Homo sapiens
gcacgagctcgtgccgtttttttaaacctccatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735809 - DNA, 2419 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaaccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735810 - DNA, 2315 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735811 - DNA, 2209 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735812 - DNA, 1624 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctgaatttggaaagtggagcaaagaatcatgcaaaaaattaagaaaaccaaaacgcaaccaaggcgaattcaattgcatttttttttcccagcgacactttctgagacacgaacctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggcctgtgccggcctcctgggtgggacccagcggagacagggccaggggcggtggggaggttcagcctgcgtgtgtcgaggcccccccaggccagaggtcccggggtccatgtcccatgcctgggggccaccccgagcaccgggaacccggcctgtggcgtggccaggcaggttcggcctgcggcagaaattcattcacttttcccgggcttcagacccaagagggacctaggttcggaaacaggccggatccccctctccccccacaggccagggcgctggagagggacgtcgccgggacagagtaggctgtggctgcccggacgcccccagagcttcccctagggcctcagcattttaggcctggttttggagggctgaagcctcacccgagagcctgtgacgcattatgtaactggc

SEQ ID NO: 735813 - DNA, 1554 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccagggtacaccgggcggcgggcgtgcagcgagcggcacggcgcggaggcctgtgccggcctcctgggtgggacccagcggagacagggccaggggcggtggggaggttcagcctgcgtgtgtcgaggcccccccaggccagaggtcccggggtccatgtcccatgcctgggggccaccccgagcaccgggaacccggcctgtggcgtggccaggcaggttcggcctgcggcagaaattcattcacttttcccgggcttcagacccaagagggacctaggttcggaaacaggccggatccccctctccccccacaggccagggcgctggagagggacgtcgccgggacagagtaggctgtggctgcccggacgcccccagagcttcccctagggcctcagcattttaggcctggttttggagggctgaagcctcacccgagagcctgtgacgcattatgtaactggc

SEQ ID NO: 735814 - DNA, 2346 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735815 - DNA, 2448 bp, Homo sapiens
  misc_feature (2371)..(2371): n is a, c, g, or t
  misc_feature (2419)..(2419): n is a, c, g, or t
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaacctcgaggtcgacggtatcgataagcttgatatcgaattcggcacgagggaggntgaggtctggggttctttaaagtctctggtgggctgcctcatgacttnaatcagcttggaactgccagtgcaccagc

SEQ ID NO: 735816 - DNA, 2328 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagtggagtagcactggtaccgagctcga

SEQ ID NO: 735817 - DNA, 2377 bp, Homo sapiens
  misc_feature (2305)..(2306): n is a, c, g, or t
  misc_feature (2309)..(2309): n is a, c, g, or t
  misc_feature (2317)..(2317): n is a, c, g, or t
  misc_feature (2320)..(2321): n is a, c, g, or t
  misc_feature (2342)..(2342): n is a, c, g, or t
  misc_feature (2349)..(2349): n is a, c, g, or t
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagcanntgngatccttntgnnccttacactaagcaacagagngaataantcctcgggggggtgcccggaccccaatt

SEQ ID NO: 735818 - DNA, 2357 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaggttgctaacgtcctacgtgtacctgatgctcgacattctgtacatcactggtc

SEQ ID NO: 735819 - DNA, 2247 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaactccaaaccagcttttcttacccccatgaagaacgatcaatttaaaaaacacagatctcaggtttcctcccaagctgtcagcgagcgctgctgccggtctagattgcgtcgacg

SEQ ID NO: 735820 - DNA, 2186 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaattcactggccgtcgttttacaacgtcgtgactgggaaaaccctggcgttacccaacttaatcgccttgcagcacatccccctttcgccagctggcgtaatagcgaaaaggccggaacgatcggccttcccaacagttgcgcagcctgaatgcgaatggcacttgtagcgtcatatttgtcaaatcccgttacatttgggcagccatattaccatagcgaacggggaccccttatactacgaaggtggtttgccttggaagaccaattaaggggcactgggacgtctggggcct

SEQ ID NO: 735821 - DNA, 1917 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaactgcggggagtttcaacacacgtctaataatatactcggagggggggggggggggggggcgccccccccccccccccccccccgggggggggggggggctgtcgtcccc

SEQ ID NO: 735822 - DNA, 1817 bp, Homo sapiens
  misc_feature (1727)..(1727): n is a, c, g, or t
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgtcaacttgactcnttgggggcattggacggcagggccacatcttctgatccccattaacaccggcgcgaaacgtctacacccaacctcgggacacaaacgctc

SEQ ID NO: 735823 - DNA, 1959 bp, Homo sapiens
  misc_feature (1679)..(1680): n is a, c, g, or t
  misc_feature (1687)..(1688): n is a, c, g, or t
  misc_feature (1691)..(1692): n is a, c, g, or t
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcccnngcgggcnnggnnccttttaaaattttaaacccactaacctccggagatatagggctcgggatcacaacttggaccttcccttctttggggagggtctctctctcccccctggattcgccgccccgcccaaattccccccaatcctcggagcaaccccccccctcaaaagggttcagcgaagaagattattgcgggggggcggaacagaccaaacaccggtcttccgagtgggataagacaccataacacccgcgcggcacagttatctattggaaggta

SEQ ID NO: 735824 - DNA, 2194 bp, Homo sapiens
tttttttgatagcagctttatttttattttattttattttgagacagagtcttccttcgtagcccaggctggatgcgagactccatatcaaaaaaaaaaaaaaaagaaacccaaaaggtagaaaccccaagtcccatcggactctgtcttgagtccacccatactcccctttcttgagtgtgtatttttcgctttgcaataaatctttgtactttcatcattttctgacacactcttgaattccttctccagatggtgtcaagagcctggataccagctggggttgaggtcccaccagcctccgtctgaaagccgggctttcgggggaaggatccacttccaaggtcactcactggttgctggcaaaattcagttcctggaggggtgttgggctacggtctcaggtcctcgctggctgttggccagaagccgcccttggttccttgccacctgggcctctgccacacgatggcttgcttcccagaggcctgcaagcttgtccaggatggtctcaaactcctgggctcaagcgatcttcctgctttggcctcccaaagtgctgggaatacaggcatgagccaccgcgacaggccatgttgctctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccacgcagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggtggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggcagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaacagagagcttacagtggctagtgtgcgtgagtcgtgtt

SEQ ID NO: 735825 - DNA, 777 bp, Homo sapiens
ccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactaca

SEQ ID NO: 735826 - DNA, 918 bp, Homo sapiens
  misc_feature (721)..(721): n is a, c, g, or t
  misc_feature (867)..(867): n is a, c, g, or t
  misc_feature (886)..(886): n is a, c, g, or t
aggcagtctggtctgtggaatgtgttgagataatttaatactggcttggacacactggattccaggtgcaggaaccctggaaccccctggaatgtgctagagataagcataaggcatcctgtctgtgcccactccaccctggttgggagtcgcagaatgaggacctcctgacttgagacagattctttatccagagaatctgagattccaattcagatcctggagctgggcctgctactcacctccccagtaaatgtccaggcagcattggacagagaggctggccccgccctgacgggggctgaagaacaggcccccagcagccttgttgttgggctactgagcacttcagaggttgggaggacctggaacagtcgccccagatccatgtgccttctgtttggggtacacctgagtagcctctaacagccactgattggcaccaagagagaatccaaatgttggcatcacaaaccttaagtatggagcagggagcaagtgcctgggggctgtttgccccatcttatgaatgaatagctctcgtaatgtctctggatttttggagacgggaagaaatggccaagtaacagcatcctcattcccaactctactgagaatcaactacggtggaacagaacatcaggggctgcatgggtgtgcgcctcagtttccctctactgcccccaaactgcctactccaggagtttcccaaaagggaggngggagatgaggagataggcatgcaaatgcccatttggagattttcagctactctgggccattatcccatttcagagcacaccagacaggaagggcaaagaggtcccatcatgagtgccaaattgattggtactggctgcccagaanactgtgctgggaagaattntgacattcccccatgtgcttgcccttgaattg

SEQ ID NO: 735827 - DNA, 353 bp, Homo sapiens; identical to SEQ ID NO: 14531

SEQ ID NO: 735828 - DNA, 589 bp, Homo sapiens
aaattcttctcaaatataaatgtagtacattggctaaaggactaataatctagtaaatttagtagtacagtatactgaaaggtacattgatgtatgggcacaaaatacttcttatagttagtggattggtcagtttaatatgtggtctctttacacaaaggttttggttaaattaaaatgtggagaaattaatattaagacttttaaaaatattatacagatataggtgccttaaaaaaaaaaaaacaacagttacaaccaaaagaattgaaatgaccagtgcactttattttccttttagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggtaagttgaagatgacagtttgggaaattttaagtattttttaaggtcctctgaaataatacttaaggaatgtttagagaaaaataaattggccaggcgcagtggctc

SEQ ID NO: 735829 - DNA, 714 bp, Homo sapiens; identical to SEQ ID NO: 341562

SEQ ID NO: 735830 - DNA, 818 bp, Homo sapiens; identical to SEQ ID NO: 341561

SEQ ID NO: 735831 - DNA, 1483 bp, Homo sapiens
cgctgcagttggcaggctgctgcgggaggcggcggcggtaggaagccggagacagcagggtgacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgagtacaaaatccccatagtccacacatggagtcaagtaaatttatcactgtttttacagactgtcttagcacgtgatattaaaagaccctgtataattaaagtaattttttttgttaaaaatatcactagaaatgtgactaaatgtctaaagttattttaatatgtatttataaaatagatgtttagattgctgtataaagattaaaacaaaataagatgaggttaaattttgtctttttttgaactaaataagaacaataggaaagaagttgctttaaccttgttaccatactg

SEQ ID NO: 735832 - DNA, 1636 bp, Homo sapiens
cgctgcagttggcaggctgctgcgggaggcggcggcggtaggaagccggagacagcagggtgacaggctggagtgcagtggcgtgatctcggctcactgcagcctcgcctcctgggctcaagtgattctcctgcctctgcctcctgaatagctggcactacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgagtacaaaatccccatagtccacacatggagtcaagtaaatttatcactgtttttacagactgtcttagcacgtgatattaaaagaccctgtataattaaagtaattttttttgttaaaaatatcactagaaatgtgactaaatgtctaaagttattttaatatgtatttataaaatagatgtttagattgctgtataaagattaaaacaaaataagatgaggttaaattttgtctttttttgaactaaataagaacaataggaaagaagttgctttaaccttgttaccatactg

SEQ ID NO: 735833 - DNA, 354 bp, Homo sapiens
  misc_feature (338)..(338): n is a, c, g, or t
caagcgtgagccactgtgacctgcctttgtttcatattttcttccgtgtttttttcttccccccctcctgttgcccaggctggagtgcagtggcgtgatctcggctcactgcagcctcgcctcctgggctcaagtgattctcctgcctctgcctcctgaatagctggcactacaggtgcgtaccactgcactgggctagtttttgtatttttaatagggatggggtttcactatgtcgcacaagttagcctcgaactcctgagttcaagtggtccacccgccttgccctccaaaagtgctaggattacaggcatgagccaccacatgccactcaatantaagcatcctctaaca

SEQ ID NO: 735834 - DNA, 940 bp, Homo sapiens
caagcgtgagccactgtgacctgcctttgtttcatattttcttccgtgtttttttcttccccccctcctgttgcccaggctggagtgcagtggcgtgatctcggctcactgcagcctcgcctcctgggctcaagtgattctcctgcctctgcctcctgaatagctggcactacagaattggaaaatatttaactcttaacaaatgaattccccacttgaactctgccgaattcctgtgccacctcctcctttagaaaactgatcttaatacagagataaaagaggagtagaaggtaaaagaaaatgctgggaactgaccgttgtgttgtggaagaatggttatcagaattcaaggcattacctgacactcagatcaccagttatgcagcaactttacaccggaaaaaaacacttgtaccagccctctataaagttattcaagattcaaataatgagatacagcctccaagagtgcctctgctgtgtactggagtgagtttgaagaagttcagtgtatttctgaatgttttataactctgggtatgcataatgtacgtatatgcatatccatatggtcaagagttttcagaattctttgtttgaataatgaatgtgtgtattccctaccccttgttttgctctgtcttaacatttaagctttgcttattaaaatgtatttgttttaatgctttctctttagattgtaagctcttcatgggcagtggtcagatattctgtatttgtaacttcccgagaatctagtattttatcatgtacataatgaacatagaatagtattgattggaaggacagtgaagtacaaaatgagattctaaaatgacattttcattagggctcacaagtgtataagaagtatccctttcctatttttttgtttaatactttagaagctattacattaaaaaagctattctcatta

SEQ ID NO: 735835 - DNA, 1437 bp, Homo sapiens
aaattcttctcaaatataaatgtagtacattggctaaaggactaataatctagtaaatttagtagtacagtatactgaaaggtacattgatgtatgggcacaaaatacttcttatagttagtggattggtcagtttaatatgtggtctctttacacaaaggttttggttaaattaaaatgtggagaaattaatattaagacttttaaaaatattatacagatataggtgccttaaaaaaaaaaaaacaacagttacaaccaaaagaattgaaatgaccagtgcactttattttccttttagctcctggagcctgtctgccatcagctgtttgagctctatcgtagctcagaggttcgacttaagaggttcacactgcagttcttgccagaattgatgtgggtttatttacggcttacagttagccgagacagacagagtaatggttgcattgaagcacttctgttaggaatttacaatttggaaatcgctgataaagatgggaacaataaagttctgtctttcactatcccctccttatccaagccttcaatataccatgaaccttcaacaattggatccatggctttgacagaaggggcattgtgtcagcatgatctcatcagagttgtttatagtgatcttcatcctcagagggaaacattcactgcacagaaccggtttgaagtcctgagttttctcatgctgtgttataattctgctattgtatatatgcctgcctcatcttaccaatctctttgtcggatgggttccagggtttgtgtgagtggctttccacggcaacatgaaaaacactggaaagaactctgtggtcgaatagtattggatcctgaatttatggtgcaacttctcacaggggtttattatgccatgtataatggacagtgggaccttggccaggaagttcttgatgatatcatttatagagcccagctagagcttttttctcaaccactattggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgagtacaaaatccccatagtccacacatggagtcaagtaaatttatcactgtttttacagactgtcttagcacgtgatattaaaagaccctgtataattaaagtaattttttttgttaaaaatatcactagaaatgtgactaaatgtctaaagttattttaatatgtatttataaaatagatgtttagattgctgtataaagattaaaacaaaataagatgaggttaaattttgtctttttttgaactaaataagaacaataggaaagaagttgctttaaccttgttaccatactg

SEQ ID NO: 735836 - DNA, 1606 bp, Homo sapiens
  misc_feature (91)..(91): n is a, c, g, or t
  misc_feature (247)..(247): n is a, c, g, or t
  misc_feature (362)..(362): n is a, c, g, or t
cttaactcaaatgctataactggttcaaaggacaatccgaagaacacatttaatgattaggaatactgatataaacttgctaatggacaanaaatattggctttcctacaaggtaggaagcattccctctaccagacagaattcatttcctgcccacagacaagcgcgtttgcattgccagcagctatttacaacttatgaagctgtaaaacagctcccaagcaatgaaggctgcaagcagataagntggcaggccgtgagcaggcctcaaatggagttttacagtgaagcacaaatgttcccctacagaacccaagatgtctctttaaaagaaatcatgaaagaagaggggattaagtggngcttatggactgctccagggttaagtggcctccaaaataaacaacaggactgctcagtagtcagagtgaattttgggtggggtttgaaagagttccagctttcctctgctaatggtgacataaaatgttcatttcatacccatgcatatacactgatgtatacatgtagttgaggaggcagtggcagaagccagaaggctttctctgccatgagctcctcctaggagccctgggttgcagagggtgaggactgctaggaaagtccgtcagttaaggccgaagggacattagctttgccttaaaccacattggctgtgcttgcctttgtgtcttcacctgatttaatgggttttagctcacactctccgaatctatttacctccaagtcagttaaggcagactgtactgttgacaaagctaagcagaacagaatttccccatggcttctagcttcaaggaatcccagctatttatccatcaccaagaaatgaagccccatgggtggctgacggttcatttactccagcccagggtgttggatttcaattagtgcattcgcttttccctctaggcagagctcaccctttaaagtcgctccttggcctgctaactgtcttaagatgcactttcccatctcaacaatgatacaggacgtgtcttacagggctgtagttctcattcacagcattcttcctctgagtggtccaggaaatactcgcaggccttacagtcaagtcaccttagatttaaagtacggaatacgcgaaaccttcctaactggtaaagcgctcagtaatgcaagctctgggtgcaactcagtggttcttagtatagtcagagttatgcgatcatcagcacaatctactcacaccctcctcgaggtattaaataaatatttcagaatccacaatgcagccaatctcatcaataactttactgaatcctgtagcccagcactcaggggttctctaaaaccctgccccgccttcccctccaattgcggtgcccactgtctcttttaaatagactctgtcctcatcaagcctgttctctgtcccccaaatatgccgtatcattccttaatgcatgcattttttccccagttccctacaatcttataattagtggttacgctaatctatatgtgtgtttaaactcatagaattgtatacaaaaaagtcaactgtactgtgtacacacatttaaaagataaaatgtgttcttttaacgcttaaaaaaaaaaa

SEQ ID NO: 735837 - DNA, 817 bp, Homo sapiens
ctttatggtgagcaaccatataattttaaagaccgatatttttataggagaacccagatggcaaaaaatttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgttt

SEQ ID NO: 735838 - DNA, 4935 bp, Homo sapiens
tggcaggtcgaggccgggggtgagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtatacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatgggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgttt

SEQ ID NO: 735839 - DNA, 447 bp, Homo sapiens
ttctttcttcagacgacaccatcatttttgaaattttctctggtgctgcatggggacatggacaaggctatcacagtggacattgagtcatctagccgagaagaagatgtcagcatcacttcaaatctgtcctcgatcgattctttctacaccatggttcaaggtaaacacgaaagcatcattttaaacaagtaccaccagcacccagacagaatgcggcaacacccactttccaaggtgaaccagaaaagggaaggtgaaaatgtaaacctctagaaatattggtgacataatctacagtgtacatgtaatatttatttacttgtatagacatattttaaaaccacatataagataatctgtcatccttggaatagtgtctgtttccattcccatgtattaaaacaacttcattccagcccttcacatgcatcatcaggcgatttt

SEQ ID NO: 735840 - DNA, 3196 bp, Homo sapiens
  misc_feature (434)..(434): n is a, c, g, or t
  misc_feature (1163)..(1163): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggctgagacgggaggattgcttgagcccaggacttcgaggccacagtgagctatgattgtgccactgcactccaggctgagtgacagagccagaacgtatctctaaagaaaaaaaaatggccgggcgcagtggctcacgcctgtaatcccagcactttgggaggccgaggcgggcggatcacgaggtcagaagatcgagaccatcctggataacacggtgaaacccccgtctctactaaaaatacaaaaaaaatagccgggcgtggtggcgggcgcctgtagtcccagctactcgggaggctgaggcaggagaatggcgtgaacccgggaggcgcagcttgcagtgagccgagatcgcgccactgcactccagtctctgggcgacagagcgagactccgcctcaaaaaaaaaaagatacctctttctgagaaagaagacaaaattgcaagatacaagatgtagggccttggaaagggaagggactcgtgtaagggagaagcccaaagcttaagtttcagt

SEQ ID NO: 735841 - DNA, 8388 bp, Homo sapiens
  misc_feature (434)..(434): n is a, c, g, or t
  misc_feature (1163)..(1163): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtatacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatgggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgttt

SEQ ID NO: 735842 - DNA, 5612 bp, Homo sapiens
  misc_feature (434)..(434): n is a, c, g, or t
  misc_feature (1163)..(1163): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtatacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatgggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgttt

SEQ ID NO: 735843 - DNA, 2437 bp, Homo sapiens
  misc_feature (434)..(434): n is a, c, g, or t
  misc_feature (1163)..(1163): n is a, c, g, or t
  misc_feature (1923)..(1923): n is a, c, g, or t
gccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatganattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactangtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacctgccctgtcctcagcacgcgtgtgcaaaagtgaacaataaatcatttcaaagatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggcccccttcaaaatttcccccgaggggccccagtttttcccgatccccccttttttttgtaaaaagggggcccctaaagagggggccctttttaaaaacttggggcttggggccccccttttttaaaacccccggtgatgggaaaaaattggttaaattgggggacttttttggggggagggaaaccttttttttttgggggggggggcaaatttttggggaaaaatattttttcttcgagaaatttttttaacctctccttgggggaaaaattaaaaattttttttttaaggggggaaaaaagggggggaaaaaaaaaaaacggcgcaaaaatttgcttttgccgcttttttaaaaaaaaatttttcccctccccccggggagaataagacattttctggggggaaaaatattttttttcccccccccggggggacccctttgggggactctcccccaaaatttttttttttgggggggaatattttttttaaaaaaatccccccc

SEQ ID NO: 735844 - DNA, 2113 bp, Homo sapiens
tttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgaaaactatatttggcaccattaatacaaaggctgggatcgttgtgatgagtgctggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccaaaggaagataacagtgtggtgtccagagatgaaaccaagtggttgatgggcagttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaaaaattagccaggcatggttgcagacgcctgtaatctcagcttctcaggaggctgaggcaggagaattgcatgaacctaggaggcggaggttgcagtgagccaagatcgcaccactgcactccagcctgggcaacacagcaaggctgtctcaa

SEQ ID NO: 735845 - DNA, 2059 bp, Homo sapiens
tttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgctttttggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccaaaggaagataacagtgtggtgtccagagatgaaaccaagtggttgatgggcagttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaaaaattagccaggcatggttgcagacgcctgtaatctcagcttctcaggaggctgaggcaggagaattgcatgaacctaggaggcggaggttgcagtgagccaagatcgcaccactgcactccagcctgggcaacacagcaaggctgtctcaa

SEQ ID NO: 735846 - DNA, 2058 bp, Homo sapiens
tttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgaaaactatatttggcaccattaatacaaaggctgggatcgttgtgatgagtgctggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggcttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaaaaattagccaggcatggttgcagacgcctgtaatctcagcttctcaggaggctgaggcaggagaattgcatgaacctaggaggcggaggttgcagtgagccaagatcgcaccactgcactccagcctgggcaacacagcaaggctgtctcaa

SEQ ID NO: 735847 - DNA, 2204 bp, Homo sapiens
aactgttaactgaaggtgactcagggtaactaattctggatctttgggtgcacagcctctcactggagtctgagaggaggaggtggagactatcagtgcacggcccgcaaccaggaaggactcccagactaacgccaaaggtgtgttgggctcagctgctccactgtggaaaaggaaagccctggccctgtggcaggagaggattgttctagtcaagtgtggcgttgcacggacaggcggtgccgagtgtttgggtgcagacacaggcagctgctgccctccacttcctgctcttgcaagtcacagatgattccagtacaatgtgggaggtcctccttacaggggcacttgcaacaggaaggcagagagtttcgtcaattcaggtacaggtctgtctgggagacctggccctgtggaggcaggaacaccgtgcaggggcatggcagcgcctgtctttgctatcacatcatttgccttttccttgtaggacccaaagatctatgtccaaaacttagtccagaaacatctgcattcctgtttaaacttcagctcagtttcttaaccaagaaccacgtcaaccctccagggttgtggtttgtatttttgcctttaagcattatctcctttccaccaagaagcctacttaggtttaacacatgaaagcagtgtcagggaatttttttaacacacagtgtagagcctttgccagagatgttgaaagggagattaaaggcttgagggatgaatttgatcatcattcttaaagtcccttccaatcctgtgattctctgattccctgagtctcgtttattattggacatgcctagcccatcaccagtgacctgcccgcatattgctggcttcccttggataacggagagcctatcaccacatgcctttgttgtcttccatcatatcaagtgagttgctttctggactttttccatctagagcctgctaggtttggttttgagaaaagatggtgaagtttcttttcatgagtttgtagggcaaaaaaaattctttttaaagatggtaagggtggaaattaatcatggtaccatctcattaaaaatagatacctcaaaatgtttacctttacaagtcaagaagagtatctgactttcttggaagtgtcaagaattgcaggttggctgaaaagttagattgagaatctgaccttgttacttatgattcttttttcccttggttctcggggatgcatgagaaggtgagctgtcactcacaaaaaaagggaaaatgatttgaaaaatgtttcacatatacactttttatcattttagtggatggcagccttacgtcagtagtatatgccactatgaagtatggccaaaaccctagcgtcacttgtaaccattgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatgttgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcacca

SEQ ID NO: 735848 - DNA, 2261 bp, Homo sapiens
aactgttaactgaaggtgactcagggtaactaattctggatctttgggtgcacagcctctcactggagtctgagaggaggaggtggagactatcagtgcacggcccgcaaccaggaaggactcccagactaacgccaaaggtgtgttgggctcagctgctccactgtggaaaaggaaagccctggccctgtggcaggagaggattgttctagtcaagtgtggcgttgcacggacaggcggtgccgagtgtttgggtgcagacacaggcagctgctgccctccacttcctgctcttgcaagtcacagatgattccagtacaatgtgggaggtcctccttacaggggcacttgcaacaggaaggcagagagtttcgtcaattcaggtacaggtctgtctgggagacctggccctgtggaggcaggaacaccgtgcaggggcatggcagcgcctgtctttgctatcacatcatttgccttttccttgtaggacccaaagatctatgtccaaaacttagtccagaaacatctgcattcctgtttaaacttcagctcagtttcttaaccaagaaccacgtcaaccctccagggttgtggtttgtatttttgcctttaagcattatctcctttccaccaagaagcctacttaggtttaacacatgaaagcagtgtctaaaaattagatcggtcctaaattggaatgggatgtcttccttgcatgtcccataccagggaatttttttaacacacagtgtagagcctttgccagagatgttgaaagggagattaaaggcttgagggatgaatttgatcatcattcttaaagtcccttccaatcctgtgattctctgattccctgagtctcgtttattattggacatgcctagcccatcaccagtgacctgcccgcatattgctggcttcccttggataacggagagcctatcaccacatgcctttgttgtcttccatcatatcaagtgagttgctttctggactttttccatctagagcctgctaggtttggttttgagaaaagatggtgaagtttcttttcatgagtttgtagggcaaaaaaaattctttttaaagatggtaagggtggaaattaatcatggtaccatctcattaaaaatagatacctcaaaatgtttacctttacaagtcaagaagagtatctgactttcttggaagtgtcaagaattgcaggttggctgaaaagttagattgagaatctgaccttgttacttatgattcttttttcccttggttctcggggatgcatgagaaggtgagctgtcactcacaaaaaaagggaaaatgatttgaaaaatgtttcacatatacactttttatcattttagtggatggcagccttacgtcagtagtatatgccactatgaagtatggccaaaaccctagcgtcacttgtaaccattgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatgttgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcacca

SEQ ID NO: 735849 - DNA, 3655 bp, Homo sapiens
  misc_feature (88)..(88): n is a, c, g, or t
  misc_feature (277)..(277): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagagtaagttcctgcagcctgcagaccgcttcaggttaaggcgagaatttaatctgagccttgcactcagcgccgcaaccatcactcaggttgctctagtttctgctggtttagaatatagtccacggcaagcagtaaaagctctcctttgccaccaagagatttgtggtatcctgtgagatgagagaagagaaaatacactcaaagaattcatctctgtgttctttctaatttctaggttatgtgcctttaaattagctgctcccagaacaaacccttctgtctgctcatttacttgagaattacccaggagtataagggctcaggattcactttctgtcccaagctggtatctttacaggagttgagtgagtccatgggtccagaaggtttcattttccgggaagagctaagtcgctttacccaagaggcaaatattcccagttgcccagttactcagctggctgcttgtcagacctgcccagtaacccaggacataggttacttaccccttggtgtgctgtgga

SEQ ID NO: 735850 - DNA, 3493 bp, Homo sapiens
  misc_feature (88)..(88): n is a, c, g, or t
  misc_feature (277)..(277): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaaggtaagatgccatcttattaagaagctttccatctttggcctcatataaatatacaggagcaccaagaacatgggaggcactgttctaaaggttatccttgggtagccggccatggtggcatgtgtctgtagtcccagctactcaggagatttaggagggaggattgcttgagtccaggagttgaaggctacagtgagctttgatcacatcactgcactctagcctgagcaacaaagcaagacctcatctctta

SEQ ID NO: 735851 - DNA, 3981 bp, Homo sapiens
  misc_feature (88)..(88): n is a, c, g, or t
  misc_feature (277)..(277): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 735852 - DNA, 3945 bp, Homo sapiens
  misc_feature (88)..(88): n is a, c, g, or t
  misc_feature (277)..(277): n is a, c, g, or t
  misc_feature (3933)..(3934): n is a, c, g, or t
  misc_feature (3937)..(3938): n is a, c, g, or t
  misc_feature (3942)..(3942): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgaaaaaaaaaaaanntannatcntta

SEQ ID NO: 735853 - DNA, 4001 bp, Homo sapiens
  misc_feature (88)..(88): n is a, c, g, or t
  misc_feature (277)..(277): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatgttgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcacca

SEQ ID NO: 735854 - DNA, 4128 bp, Homo sapiens
  misc_feature (88)..(88): n is a, c, g, or t
  misc_feature (277)..(277): n is a, c, g, or t
aaaatattttaagagatttattctgagccaaatatgagtgaccgtggcccgtgacatagcccttaggaggtcctgagaacatgtgccnaaggtggtcggggtacagctgagttttatatatcttaagaaggcatgagacatcaatcaaatacatttaagaaatacattggtttggttcagaaaagtgggaccacttaaagcgggggcttcaaggctataggtaaatttaaacgttttttggttgacaattggttgagtttatctgaagacctgggancaacggaaaggaatgttcaggttaaggtaaaggattgtggagaccaggttttattgtgcagaggaatcttttagatagcagcctttagagacagcaggttgtaaaatgttccttaccagacctaaaacggtgcctggctcttagttggttatctcctgggtgtaggaaggaaggaaggaaaacaaaggggaaaggggatatagaatgtggatttttcccacaagagactttgcagggcaattttaaggcatggcaaggaaatataatttggggtaaaacattttgattttcttccttgttacgccagagtcagactggaaagtaagtcatgacctacatggtcaaaacccatctgatgagaatttatggtttttgtaggccatgactccccagaccccttagataggaatttgggcaagataaaaaagcagagcttagtcttcacgatcaaccccacatgccaggccttctggtaggcacctaacattcagtcagtaactacagtaactctgtccgttgtctggagcaagctaaaaaggctggattgctggggaaatggaaagaagccagcactaggggcctgggttcaagtctggagggaaggaggggttgtttagccctaactttgcactaaagtaaccttggctgtgtaatttagccatctaagaaaacgaggggatagacaccccatatgttctctgagctcccttgaagatgtctgtatgaaagattctctccttttcatgtcccttccgtgccactattccgagcatcagtctgaccctaggagtggtgacgtcctactcagctgggggctgcccctcagttcccatagaggcaagtctgggtcctgacttggccaatggccctggaggccgctgagctcctcaggcccatagcgcagaaagtgggcgataggtcattccaggacaagggggcggaggctccaagaaactacgactcccaggaggccactgggttccctccggcagcctgggcctggtgcatgttgggagcagtaagcggcctcccgccgcgcttcattgttaagaccgctaggccaggtagcccgcgcgcatgccaagtcacgtcccaacgagttgggcggctttccttcctgcaggcctcttctctttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcccggggagtcgcggaggggaggggtgaaaatgggcttgcgggactgacgcacgcgcattgggataccagatccccgcctcctgctccaggtttcccctcctccttcaccaccctcccggaagtggagccgccctcgcgcccaccagcggctaccccctgcggcaggccccgcccacacaggctccgccccccggcgctccgccccctcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaaaaattagccaggcatggttgcagacgcctgtaatctcagcttctcaggaggctgaggcaggagaattgcatgaacctaggaggcggaggttgcagtgagccaagatcgcaccactgcactccagcctgggcaacacagcaaggctgtctcaa

SEQ ID NO: 735855 - DNA, 1700 bp, Homo sapiens
agtttgatctcagactgctgtgctagcaatcagcaagactgtgggcgtaggaccctccgagccaggagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 735856 - DNA, 1268 bp, Homo sapiens; identical to SEQ ID NO: 323042

SEQ ID NO: 735857 - DNA, 1181 bp, Homo sapiens
attagactattttactggcaagtccttctgagctcaaacttagcaaaagccctgtggttttaaaagctcgggtggagattatcacagacaccattggagcaacattctccagaaggacttttagaaattttcatctctttcccattttaaagactataagatttcttgtattttttttttatcataactggtcaccagggaataaaggcagatctgaggagcattcctgtcagtgaagcagttttagccacgaggccaaaatttagagcctaatgtcatcctagatctctctcattcatatgtcaccaccttttcccctcagaagctttctttgctccttctagacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 735858 - DNA, 2005 bp, Homo sapiens
gtgacaggggaaacaggcagaacaagtcagggcaaaggaccccagcatgaagagttgtggaggtggaggtggggaagcagcctcacatctcacacttccttccttctcttaaatgtgagcagctgactccaagccttgtggaaactctagaaggtagaaccagccatctggggaagctggccttacagatgccccgtctggcatagtggaggttcctgtgctctgagaacgcagtgtgaatctagacatccactgcagcctgggaagagctgtgttttcttcaaaagtctttaactttcacagtcacccctctaaagaaatgttctctgattgaaggcatgcttctattcctactttattgtgtttcatgcattctgccagagtaattacttttcataccaattcttggatgcagagaaatctctggtagtctaaggggatttcgatccaagtaaagctactatctcctattccatccagacttttccgtctgcctccattctctcagtcacatacctagaagcaagccagaaagcctgtccaaccaaaatcactctccaaagcccaagcactttattgttctccctgtctgttatcgagccaaggtgtatttggcctcattttatgccattagttgtctggctttcatggctctgcaccacattacagtcagagcaggaaggccagcagtggagatagaattatggcagaaacccagagtagaggcctctgctggtgagggagcctgcagcactctccacgctggtgggtcctagcatgcccaacagacccccatcccttcccatcagccttgggccttgagtctcattccaactcatcccctcccctttcccttctttccagtcccaggtgacacttgatgcctctgactcctttgaagagggcatcaagaagtgaaagaacaaagtccttttctgttcgggatctgggcccatcctgggagaggtttttggcagaaatggctgcagtggaaccctctgactgccagggtgaaatagtgctccagcaggctgcggtagactcgctgccagagtgggtcaggactggcccagaggacagggtcgtctcttgagagtcctcccagctccagggcctgattttaaagcagtaacacgaggatataggttatatacaggctcctggaaggcaggtgccgcagctcctgtgacaccccatatgcctgagcaagcttctccagcacaagagatgatgcaagtatgaatgggtacggggggagcttaaaacctgccaacactgagacttgatgccaggggccgtgcacccgctctgccacctgctaggtctgtgcaatggtcagagcagaggtgtgtgatgagttcagctcccaagcacatccacacttaggaagtgttctgtgtgtttttaaataatccttaccatgtaaagattgtattacatttgtatacaaaatttttttgcattttacttttgtaatatttggggttttatagatttttattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgcaataaacatgtattgaaagcact

SEQ ID NO: 735859 - DNA, 1700 bp, Homo sapiens
  misc_feature (1045)..(1045): n is a, c, g, or t
gggattacaggcgcccaccaccacgcccggctaatttttgtatttttaatggagacggggtttcaccttgttggccaggctggtctcaaactcctgacctcaagtgatccacccacctcagcttcccaaagtgctggaattacaggcgtgagccctcgcgcccagttcaacatctttcttaagtgggcccaaggttggggggaaaatctcaccgtagagatatttgttagatatcgagcatgtgctgaagaaggcatctgtgatgattaattttatgtgtcagttggactggaccatggggtgcccagatatcagcttgaacattactctgggtccatctgtgagggcgtggggtaggactggcatttatgttggtggagcaagtaaagcaggctgcctccctaacgcaggggatcctcatccatcagctgagggcccaaatagaacaaaaggctgagttggagggcgcccctcctgcatgaccaactttcaagtggtgacatcagctttcttcctgtttttggacttgaactgaaacatcagctcttcctggatcttcagcctgctggccttcagactagaactacaacctcggctctcctgggtctcggcttgctgactcaccctgcagaacttgggacttgtcagcctctacatttgtatgagccaattccttataatgtctttctgtatatatacatatatctccacatcttattgttctgcttctctggagaaccctgagtaatacagcatcattccaagatcagcagaaatgttagtgcttctggggaattactgcaaagggtacctgaatagcagcacatgctctcagtacccccgccttctgttgtctgctgttgcctgctccctccccaccctttgggttgatttcaggatagagatatggggatgggactggggttgggtgtgcggttacccagaacagccaggatgtgtgcacgctgtgacccaggagcatcaagcactgctcaagctgcttggaaaagaaaacaaaagtcaggaaagtgaggagctgggaggntgctggaaaggagcaggaagaaacgggcaagggtaggagagaagcagaaaaaacaatccctgagacagagctggtgtaaccaaggctctgtttcccccacggtttgagagtgggtgagcctgacttcaaggcccagctctgttcaaagataggacactgattttcttcaagaaggcagagctggtgagtggcctcatgtcttaccatcatggaaaggcgagggctgggggagagagaaggggcagccaaggcctcagagtggtgtaggcctcacccttgtgctcacatgtcccaaccactgccagcggtgccacctctgaatcccagaccccacatgtaaccatcctctacctggaccacaggaggaagctccacgttctttgccagggttcagggtaaggggcatgatctaagttgggcaaaagagagtcatcctgttaccttaaaaaggagtctagggtgagccccagtctgctggtggccatcttcaccacctttggggagagatggcctgagcagacacacaaagcaaagaggtggagagaaactgtgtctttgtgtcattgtttgagtccctggacccagcccagtccccccgactacgctgaacttttcaattgtggaaaacaataaattccatttagttaagaaaatt

SEQ ID NO: 735860 - DNA, 1010 bp, Homo sapiens
ggacgcgtgggtcgacccacgcgccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttgagacgggagtcttactttgttgcccaggctggtctcaaactcctggcttcaagcaatccttccactttggccttccaaagtgctgggattacaggcatgagccaccatgcccagcctccttctcttactagctgagaactaagagaagacactctggagacagaggaggaaacagtgacgatgccacatgatgaatacataatggagggtgaagacaaggctccgtcaggggcaccaaggagggaaacccagttctgtggggaaggtatggggcagcttcacaagcccagtgtctgctccctttgtgggagacgtgttgtttcagcatccattcccccttcttttaggaaaagtgcttgaatttccttttcatggaaccacccacctccctctcatccatgcattctattcccagtatcaggggtagacaagtgacttcaggcttggccaattagggttctgactcttggtcaaatcagagtgaatcctgagtcatttgtaaactccaaggaaagggcttgctttgttttctgttgaatgcagtgctctgagatagccggaaatgaaactgctctcttgccacactgaaggctagagaagggcctggccaggaaatgatgccagtgatcaggggtggagctggaagagggggagtgaggaggcccagacatcttgggagccccaaattcacctcaggatttaacttctccgctgctcagccaataaattcctttcttccatgacaaaaaaacaacacaaaaaacgggcg

SEQ ID NO: 735861 - DNA, 881 bp, Homo sapiens
agagagttcggaagcactcttattatcttagcagcagcatgtgtggaaatcatttctcattacagcggagggcaggcattgtgcagagggttaagtgggcctgcttgaagttggttgttgttagctctcatgtctatgccttggtccctttcccctcaggacttggagagcaagctgtttgagtctgatgcaacccctgggctttgactatcatgccaaaaggcagcaaataagtgccttttcttcccttcagaatacatggacaatccaaagctctattagtctattattcagaatgaaaagtgtttacaatattcgtcctcttactcctcagtatgtgagactgttcctcgtagcaggtaatttcttccgaattcaaaaactcctcatggaagcatctgtttttgtcatcaaggagggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttggtgagtatctggctcagtttaggttaatatcatctcttcagcctggcccagtttaccactatgggaaggagcccagcagcaggggctgccagacctggaaatagatctgctcattgcagtgtggcaggtgcagagaaacagagccagctatagctggaagagaatcttagggcacagagatgcaccaacatgtatgaacaagtcgagacccaagtaccaag

SEQ ID NO: 735862 - DNA, 1950 bp, Homo sapiens
  misc_feature (1295)..(1295): n is a, c, g, or t
agagagttcggaagcactcttattatcttagcagcagcatgtgtggaaatcatttctcattacagcggagggcaggcattgtgcagagggttaagtgggcctgcttgaagttggttgttgttagctctcatgtctatgccttggtccctttcccctcaggacttggagagcaagctgtttgagtctgatgcaacccctgggctttgactatcatgccaaaaggcagcaaataagtgccttttcttcccttcagaatacatggacaatccaaagctctattagtctattattcagaatgaaaagtgtttacaatattcgtcctcttactcctcagtatgtgagactgttcctcgtagcaggtaatttcttccgaattcaaaaactcctcatggaagcatctgtttttgtcatcaaggagggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttggggatcctcatccatcagctgagggcccaaatagaacaaaaggctgagttggagggcgcccctcctgcatgaccaactttcaagtggtgacatcagctttcttcctgtttttggacttgaactgaaacatcagctcttcctggatcttcagcctgctggccttcagactagaactacaacctcggctctcctgggtctcggcttgctgactcaccctgcagaacttgggacttgtcagcctctacatttgtatgagccaattccttataatgtctttctgtatatatacatatatctccacatcttattgttctgcttctctggagaaccctgagtaatacagcatcattccaagatcagcagaaatgttagtgcttctggggaattactgcaaagggtacctgaatagcagcacatgctctcagtacccccgccttctgttgtctgctgttgcctgctccctccccaccctttgggttgatttcaggatagagatatggggatgggactggggttgggtgtgcggttacccagaacagccaggatgtgtgcacgctgtgacccaggagcatcaagcactgctcaagctgcttggaaaagaaaacaaaagtcaggaaagtgaggagctgggaggntgctggaaaggagcaggaagaaacgggcaagggtaggagagaagcagaaaaaacaatccctgagacagagctggtgtaaccaaggctctgtttcccccacggtttgagagtgggtgagcctgacttcaaggcccagctctgttcaaagataggacactgattttcttcaagaaggcagagctggtgagtggcctcatgtcttaccatcatggaaaggcgagggctgggggagagagaaggggcagccaaggcctcagagtggtgtaggcctcacccttgtgctcacatgtcccaaccactgccagcggtgccacctctgaatcccagaccccacatgtaaccatcctctacctggaccacaggaggaagctccacgttctttgccagggttcagggtaaggggcatgatctaagttgggcaaaagagagtcatcctgttaccttaaaaaggagtctagggtgagccccagtctgctggtggccatcttcaccacctttggggagagatggcctgagcagacacacaaagcaaagaggtggagagaaactgtgtctttgtgtcattgtttgagtccctggacccagcccagtccccccgactacgctgaacttttcaattgtggaaaacaataaattccatttagttaagaaaatt

SEQ ID NO: 735863 - DNA, 1799 bp, Homo sapiens
tagcctccaaactgtgagacaatacatttctgttgcttaagccactcagttagtgtgctttattttggcagtcttagcaaactaatacatcccccaatccagaactgtcctcctttggataataaaaacagcaataattatagtgtcattaccctgagtgactggtcccactgttggtcattctttgtagatgtgagttattgccctattgagatcagaagtcctctcacttagaggcatatctaagacttttttcttgtggagggagctcactcaactgtaggtaaggtttgactcatctgggttagtagtaagaacaaacttccaagtggcaccatcttaaaggtgcaagcccatgtgggcgatgaccaggtctggtatattaagaggctcttggtagcacattagaaacacctggagagattttaaaatttacaaagcctagccaaaccccagacccattaaccctgactctctgagaataggaccctggcacctgtgttttaaggattctaggtgatttcaatgtgtagccaaggttcactgccatagcctgtcctggaatgcaggtaactaaaacttcagcagattatgaaaaacaaaagttactttcttggatgcatatattcttatagcctcaaaactgaaactgcaaactgaacaatgctgcagtcagatacacacacatatttcaactgcataacttcctttaataatacttttatttttccaaatttgaagactgtccctaagtcatttcttctaaaagttagtaataatcccaccaactcacatttacatagaagttacagtttaaagtttgcatctcgtaataacttggtgagatagggcaagcattatttctaatttgcatatgagaaaaaactaaggctcggatgagttatgtgacttccctgagtcatgttagagtaactaactcctgatttgtaaactgaaggtcccaaatcctgggaactccctcagctctgggcaagccaggacaggtaggtcaccctgcacctacacaaggactgagctgagttctagttacctgctgtgaaggactgtagaggttatctaagccagctcctccttttactggaaaaggaaaagactgagataagtttccaaaacccctgctggagcaccttctacttctagaaagatgttgaggggcttccagggcacaaaggaaagagaagtaactgtgtctccttccccaaccatgtatgtgatacattcattctctaggattggaaattcccagaaagctgtgtcagcaatgagatttgtttcattgttttgccttgttttgtcattgagttgttatagttaaagtttattattttttaatgcagaaaaaagtgacttttgggggagtgcagagttctatgaatttttaacacatgtctagttatttgaccacaaccgtaatcaagatacagaacagttttatcatttcaagtgctctcctgctatgcttttataacacacccttccccaccccaactcctggcaattactgctctattctccgtaactgtagttttgccttttcgagaatatcatataaataatcatgtattatgtaacattctgagacaggcttctttcacccagcataatgcctttgagattcatccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatccacgt

SEQ ID NO: 735864 - DNA, 760 bp, Homo sapiens
  misc_feature (1)..(1): n is a, c, g, or t
ncaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttcctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagtaaaaaa

SEQ ID NO: 735865 - DNA, 631 bp, Homo sapiens
  misc_feature (1)..(1): n is a, c, g, or t
ncaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttcctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcacactgtcgagagggatcctctagacgcccca

SEQ ID NO: 735866 - DNA, 324 bp, Homo sapiens; identical to SEQ ID NO: 443850

SEQ ID NO: 735867 - DNA, 1923 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttg

SEQ ID NO: 735868 - DNA, 1667 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttg

SEQ ID NO: 735869 - DNA, 1403 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatg

SEQ ID NO: 735870 - DNA, 1598 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccgggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatg

SEQ ID NO: 735871 - DNA, 1162 bp, Homo sapiens
gtattctggaaacactctcttaatttccccgctacagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatg

SEQ ID NO: 735872 - DNA, 1362 bp, Homo sapiens
gatcacggttactgtgacctgactggagaaaaattatgtgtctgcaatgatatttcggcaggtcctgacactccggtgaaagtcacctccacggagtcgtactggattccgccacacgttaaacccttcagtccttctgtaggtcgggcttcacataaagcagttttacacgggaaatttatgtgggtgattggtggatatacttttaactacagttcttttcaaatggtcctaaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatg

SEQ ID NO: 735873 - DNA, 666 bp, Homo sapiens
  misc_feature (661)..(661): n is a, c, g, or t
agatccaggtaacacatttttattgtaaaatatccacttgagttgaaaaagttgtcaaatacaagtttaaggatacgttatatattttgcttagttgtgaaaataatgtacatttagaatttaaatcacttaaattcattccattgtaccaatattatttatgcatccttatacttaagaatagcatctactaagacaattatgcagaaaagatcccagggataatgcaacacctaaatataatggtgggggagataagagtaaatgtactaatgagttgtctaactaaagaatagttcaattttattttttcaaaggcattttattcttgactttaacattaaaagtactcaagggattggggcataagtcagtgagaaggcttattaagttttctacattaaggtatgaagagtttttaagtcttacgggctttaagactttttttaaagaaaatcactgactacatgagctaaaagtagaaaagcatattttaagtgttaatctgaataccttaaatatagtgattttaatgctcaaaattacaatttagatattctggtatttagagaaatgtaaaaataccggcattttagtatttagatttgctaaaacatagtaactcaaagcagttacgttttgagttatccataatattagnatagg

SEQ ID NO: 735874 - DNA, 1866 bp, Homo sapiens
  misc_feature (1346)..(1346): n is a, c, g, or t
cattgctgtgaaatcttttatttttgttttatgacacagcatcaatttcatgaatactttgaaagggccattagaaaaaataagagccaatttgggtcatttgagaaacattttcagcacaattacagtgggggcacgggccgttcggctccagctgggttttcccagatgcaacaatcgcggttctggcttctccactggtggggatggggatcgcgccttcggagctctcagggcgcctgtctgtcgggggctgggtgcgtccacagccccgggggatggcgcgtggcgtagcccaggaacggcatgtgggtgggtctctgacctgcttgtgcagggacttgagggacctcatcccgatggccgaggcaggggctccccacgggataaaaggatccggcctggccttggggtccaagaggagggccaagggagtggacctggcccctgtcccctctcctcctcgaaacactggacaccctgaagcgagactatggctgctgaggatcctgtgtgatgtggccgcggggcgtcccctctggcctcaggggaagaaggactgggcggctcggcccaggtcaccctctaggaagcagaggaggtgcaggtgccagttcagggcagaaagaaagagccactgaggccattgtcctgaaggcggtgacccccaggcactcctgctgccccccaggaagccctgggctgcgctggacaccgggccgagtctccgtcttctggaccgaggctcttctgggctttcaggctcagctcgtcggtccattcagcaagttcaggggcagactgagccctgctctggccatggctcagccggaaacaagagctgccatgttcgtagcacctgagtacccccgccggggaggtctctgtcatctcatgtccccgctgggcaggtgccccacagcaggggagccctgggctctctctgtcccaagctcccagctgcatccaacctcagctcacagttgtggatcaccctgaccttccagagttcccctcccaaggggcagacccagcatcctggagtccccaccccgagctgtgctgaaggacagctggggcggtagggccaggaccagaccaggcctctgacaaagtctcatcgaaatgaaaccaatgtgcccgggccaccttaaggggccctgaccaggaaagttaggcctgaagctgccaatgccagatcctcagggtgttacctgtgtccttacgtggctaggcctgaccccaagtgccacaacccccaacttggggagggcagggccacctggtggggacgggccagccagagcccttggtctcagctgtggcagccacatccctggcccggncttgccctgagggcctttgggacatctctgggcagaggcatgagggaggggagagtccagtagccaagtccggcagagccagtggggcaggaacgcccagcagaaggaagctgggcttggggcagcagagacgtgccaagccaccaggcctggccatgaggatgaagcacctgggcgggggaagggacgtacctgccaccccaaggctccaccaggcagagagacccaacgggctgccaactcaaaccagaacccaagcacgtcataatgtcctacagacagcatggtgccaattatatgataaccccacatcagtgagaataagtaacggcggtggcaggggctgggtggggggcacactcgctccccacacaggccagggctgagcaggaggcctcagagctgctcttggggagcaacccagggccttggggcttctctcccatgcccagaagggctgcaccaggaacacccagccctgtctcctgctccagttccacagcacccctcacaccctgcc

SEQ ID NO: 735875 - DNA, 2495 bp, Homo sapiens
tgagggcttcatggggtctgtgctccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735876 - DNA, 3244 bp, Homo sapiens
tttgaaatgagacctttgctctggagtccggcagggctcagaccctgctcaggacaagcccctaggaccagtggacactgcctgtggtccgagtgggtccctgtgccctggggcagttggcccaggaatgaggcgggtggggcgggggtgacagaggtgggccaaggggacactgcggctctttggcacccagtccttggtggtcagcaccccggtgaggtgcacacgcccacgggggcgctttccctgctcgcaggaggatgagatgcgcccaggatttcaacaagcaccgagatcaggccgggtggggctgtgtgactcccggctgtcccccagccacctatgctgcccacgcgctaggcccatttctgctggtcctggaggtggggccctgggggtgggggccctggtgacctcagcgcccctccttgctatccccagggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735877 - DNA, 444 bp, Homo sapiens; identical to SEQ ID NO: 198778

SEQ ID NO: 735878 - DNA, 2718 bp, Homo sapiens
  misc_feature (1)..(2): n is a, c, g, or t
nnaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgctgtgtccctgtcttgcctcccaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcagtagagacaggatttcaccatgttggtgaggctggtctccaactcctgaactcccgaagcccgcctcagcctcccaaagtgttgagattacaggcatcatcaggcgagagccactgcgcccggcctccacttctgccttttccaaattgacgaaataaacacttagtaatagaaacaac

SEQ ID NO: 735879 - DNA, 5367 bp, Homo sapiens
  misc_feature (1)..(2): n is a, c, g, or t
  misc_feature (2245)..(2245): n is a, c, g, or t
nnaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggtaagggctcctgcagggcctgggggcatccacatggccaggtgccctgggggtgtggggtgtgggaggaggccggggtcagggggctcgggcaggcctgctgtcctccctggacgcctcactgtgctcagcagctctgagccaggcattgcgctcctctgtggcctccagagaccagcccgaggctgtcaggacctggaagcacggtggccagtgccccttcccctgtctgcagcccctcccctgtgctagcggtggtggctgctttccaggctgaattactgggggagagcaactcatccancagggcaaagggtggaaggaggcttaacagagagcgtagcttttgagctagaaagggctgatttggtggaggggagcgccgtggcttcctgcccagctgcgggcaggacagtgccccggccctgaggctctctctgccccacaggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735880 - DNA, 6000 bp, Homo sapiens
  misc_feature (1)..(2): n is a, c, g, or t
nnaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735881 - DNA, 5975 bp, Homo sapiens
  misc_feature (1)..(2): n is a, c, g, or t
nnaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735882 - DNA, 3498 bp, Homo sapiens
cgaaggcggaaacagacactgaaacggggcgttccaggccgcagcccacatgccccacgggggagcagctaaccccagagaactgtggtcccctgataccccaggaacgcatatctgagcaggctttccagcttccctgtgtgtgaggcaggaatgacctctgtcttcattttacaagcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735883 - DNA, 5224 bp, Homo sapiens
gctgtaccgggcgaagtgtatgatatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaaaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 735884 - DNA, 891 bp, Homo sapiens
ttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttacaaataaat

SEQ ID NO: 735885 - DNA, 1095 bp, Homo sapiens
actctagacgatccctgtcaaaggtgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 735886 - DNA, 2206 bp, Homo sapiens; identical to SEQ ID NO: 371040

SEQ ID NO: 735887 - DNA, 2243 bp, Homo sapiens; identical to SEQ ID NO: 371037

SEQ ID NO: 735888 - DNA, 1801 bp, Homo sapiens; identical to SEQ ID NO: 371039

SEQ ID NO: 735889 - DNA, 889 bp, Homo sapiens
gaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctattaaaaaaaaaaaaaaaaaaaaaaaaaaaaaaaacaaaaaaaaaaaaaaaaaaaaaggggggggggcgcaaaaaaatcccccgggggggcccccacaaggcatacccattcgggcacacaggggcgcccaaaaggagaggccaaaactaacactggcaagggcgcgcgctcaaaacaggcgcgagggggaaacacgggcaacggggaaaccctgcggagaggacacccctaccagcggggggggaggcaaacaatggtggggaacaacatatactccacgtaaagtttaaaagcctcgggagagaacattttcagacattctgaggggtatgaaaggtggtgtaaacagagcgacaaatgagcggggtcggtaacaattgtgctaacgaagaaatatattgagaaaaattttcg

SEQ ID NO: 735890 - DNA, 1587 bp, Homo sapiens
gaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaacctttaaaatattgtaactgataatttccataaaaaccatttacatagtttcaacctttctgcataaaactgtattatgagataggcaaacaatctcacaagatggtctgagacataaaaa

SEQ ID NO: 735891 - DNA, 799 bp, Homo sapiens
gaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaagggtttttagtgattactgtgcattattgtctattgtcttagctatttt

SEQ ID NO: 735892 - DNA, 549 bp, Homo sapiens
  misc_feature (546)..(546): n is a, c, g, or t
gaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctattcttaaaaaaaaatgagcaagttatgtatgcgcgcgcaattcgagtcacttgggccattcgccctatagnggg

SEQ ID NO: 735893 - DNA, 2236 bp, Homo sapiens
gaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacaggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 735894 - DNA, 425 bp, Homo sapiens
  misc_feature (2)..(2): n is a, c, g, or t
  misc_feature (12)..(12): n is a, c, g, or t
gntgactctagnaggatccccaagctcccaacagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaagcacttgtttttgtaccttagta

SEQ ID NO: 735895 - DNA, 1417 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgtaagtagaagaacccaggaggtgctcccagctcacctgttgtgctgggaaagccagcttagaaacactgctttaggaaaggggacattctgttactgacaatgtggacagtatatatataaatggctacctataaaatgaggtttcctgtcgatgtttagtggtattcttctaaagaactgaaatttttattatttctgacatttctccatagcgtaataggagatttgtgtgttatgatacatatatatatgtagttaactcctataatatatatatatttgtatattatatatatagttcaaaagccatttatattgcaagtcaattgaatgctttaaatgtctttttgagaaacaatgctgcacaaatgagaacctacaccaaagaattctaccactattgtttttttccttagcatatgctgtatggaagaacttctctatctgtgtgccacaaatagctaaagctactgatcaccttagccctttgagtggcagggctgagcctgggatgattggaggccctggatggtcacctgtggccgtgagcaccttgtcagtttaccccagtgtactaggcaaatgttatttcccatgtgtgtcttgatgggaaaacagctggaaagcacactgccacatggtaaattgg

SEQ ID NO: 735896 - DNA, 2179 bp, Homo sapiens; identical to SEQ ID NO: 371042

SEQ ID NO: 735897 - DNA, 2183 bp, Homo sapiens; identical to SEQ ID NO: 371043

SEQ ID NO: 735898 - DNA, 2167 bp, Homo sapiens
tgtaaaacactttattaaaaatttctgaattaaaaagaaacttacattttggagtagaggaaacaggagttcagatattttaggagttaatatcactgcagcaacaattgtgtagtattgtaaaaggctcaggagcctcctgcttaccattggggaaggttgaaacaacttgtctcattaagttaagcttcttccctggagtgtcttatttagctttagttctcttaattctctttccctggtgatttgggtagtgtctgaaaccactaaaggtaaaaggttgaagcaatcccaaatttaataatctatcacctttctttagtgtatctgagtgtaattcccagcagttctttgtgaattcattagaagacagcaagtcattaaaagttaataagaaactatttgtttctgtgggtgtgaatacagccactttgtaagtctgacattcgttcccagtcataaaagccttgcttttagccaatttgttttttttgttgttgttctctctaggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 735899 - DNA, 1315 bp, Homo sapiens
tctagagagatccccgagtgtcttcagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcactttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaaaaaaatcttttggcgccccccccaaaattaaacctg

SEQ ID NO: 735900 - DNA, 1340 bp, Homo sapiens
tctggggctgccccaaagggcagacaggtttattgggcagcagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaaaaaaatcttttggcgccccccccaaaattaaacctg

SEQ ID NO: 735901 - DNA, 1520 bp, Homo sapiens
  misc_feature (2)..(2): n is a, c, g, or t
gnccgctctagagtatccccacagcataaactacccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaaaaaaatcttttggcgccccccccaaaattaaacctg

SEQ ID NO: 735902 - DNA, 413 bp, Homo sapiens
gaggaccccagatgcaaccaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaagcacttgtttttgtaccttagta

SEQ ID NO: 735903 - DNA, 1495 bp, Homo sapiens
ggcactcatcagctcgcacccacgcgtcgcaccccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaagcacttgtttttgtaccttagta

SEQ ID NO: 735904 - DNA, 1519 bp, Homo sapiens
ggcactcatcagctcgcacccacgcgtcgcaccccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaaaaaaatcttttggcgccccccccaaaattaaacctg

SEQ ID NO: 735905 - DNA, 1786 bp, Homo sapiens
ggcactcatcagctcgcacccacgcgtcgcaccccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaacccaccgccccaccaccgcagcgccccggcaccaccacacaccacacaataccgcgcaccagagtaccccactaacgcgatcctcactcacaaccgccatgagacgtcatcacaccgcgcagggcaacccgcaaacacgacgtccctggcaacaccccaccactccggatgcgaaaacccgaactccgatctacagaccccgcaccacaaaacacagccagacacacacctaccatcacatcaacacgcctcctccactagtcggtctgatcgctataatgccgccggtactcatcaccacccccccc

SEQ ID NO: 735906 - DNA, 1490 bp, Homo sapiens
ggcactcatcagctcgcacccacgcgtcgcaccccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaaatttaactttatttacaaatgttctcctataaacaaagatgccatgtcgacgcggccgcgaatttagtagtagta

SEQ ID NO: 735907 - DNA, 1353 bp, Homo sapiens
tcgtgccgaattcggcacgagagaacatcagtaaacagataagaagtaggagacaggattggcattatatctatggtcatgtcgaggagggacaagattgagtggtgagaagattagaatttggatagattctaaggccctggcatgactctacagggaaccagggaagtgatgtgtctcttcttcagtgcgattctctctccgaagatagctttggcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaa

SEQ ID NO: 735908 - DNA, 1331 bp, Homo sapiens
tcgtgccgaattcggcacgagagaacatcagtaaacagataagaagtaggagacaggattggcattatatctatggtcatgtcgaggagggacaagattgagtggtgagaagattagaatttggatagattctaaggccctggcatgactctacagggaaccagggaagtgatgtgtctcttcttcagtgcgattctctctccgaagatagctttggcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctgatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaa

SEQ ID NO: 735909 - DNA, 998 bp, Homo sapiens
gcccaaattgtaattttattaaatgagtggaaagaaaattacttcctaataatactgatatatgaggatttcccatattcttgacctgctgttaggcttttaataggcatctcatttaatcgcactacatcgagggtctgggcccagcacctcctatctccaagtctgacatcccttcttggacactactgttcctgtatatcttttgttatgtgcattcattaccttttgtaacatatgtgcactttgcttgctccgaagtctatggtatgcacatgtacctcacctacttcccttcactgtgatggctgatgatttttcccccagcttccgtggctatgtcacatgtccagttcattcctcgtaggtgctggaggtagtgatcaaaaggcacaaaactagagtccctgtgactgactgtgacccagcagaaagagtgcccatcacccaacctgtatttgcctgcaggtgcattcccatgtgtgtacatcaaatatcctggtcaggaaacctgtggatcattcttccatgaaataaatttgttctgttatggatagaagtgaaatagagcccctagtgtcatgaagaagaccacattagcacatcatgccactcttactattttagggactccacccagtgaagtcagtgatgtgctgttcttgcttccctagcttgaagaagagtatcagacttaatattacattcatacagtggctctatgatttgggtgataaataattgaatctgctttgctaatgtgagaaatagattattcagggtcactcaagccagggttccacttttcaaagttctaggtggtaagctagatcattaggaacccacttatttgtttacaaaatggaaattttcagtctttgtgagaatttgtcagcataacaatttgccaacagagactgttgattcagaggtgtctgtggcatgatagaattcacagcagcacagttttaaataaagttacacctttcagaaagcgc

SEQ ID NO: 735910 - DNA, 979 bp, Homo sapiens
ggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcagttgatcctgattttctaaaatcatttttattaatccatgaatcttgtaaagcatatggtgctacaccaagccaatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttg

SEQ ID NO: 735911 - DNA, 1119 bp, Homo sapiens
aagtaaaaaaagaagctgtgtcttaaagatgcatcttcctttaaagtaatgaataacaaaggtaggccataaggagcttcttatctactttaagctctggctggcttttccaggaagtttgaggagataaatcatgactcattttctgcagggtcagtggggaaactggagaggtggctgtccctgttcctgccggtgcctgaagctttcagtgttgttccatcacactctggctccatacctttcctcctgtcctccctccctgttggctggagtctaatgtgacacttcttccaaaacacagaaccgcctacattgtgtaaactgattcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgagaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatgggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccagttgtctacaaaaagcctgattggcttcaggtttttttt

SEQ ID NO: 735912 - DNA, 965 bp, Homo sapiens
aaatgtcttctacctgaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgagaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatgggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccagttgtctacaaaaagcctgattggcttcaggtttttttt

SEQ ID NO: 735913 - DNA, 1735 bp, Homo sapiens
aatttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaatttaaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcaagacctcgtctctactaaaaattaaaaaaaaaaaaaattagctgggcatggcggtggttcatgcctgtagtcctagcactttgggtgccagggcgggaggatcgtttgagctcagcagttcaagaccagcctgggcatcatagtgagaccctgtctctatttataaaaaaaaaatgaaaa

SEQ ID NO: 735914 - DNA, 1279 bp, Homo sapiens
  misc_feature (1245)..(1245): n is a, c, g, or t
  misc_feature (1257)..(1258): n is a, c, g, or t
  misc_feature (1270)..(1270): n is a, c, g, or t
aatttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaatttaaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatcctgtgggtactccnccgagcttcctnnagatgttacctntccgcatac

SEQ ID NO: 735915 - DNA, 1419 bp, Homo sapiens
aatttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcaagacctcgtctctactaaaaattaaaaaaaaaaaaaattagctgggcatggcggtggttcatgcctgtagtcctagcactttgggtgccagggcgggaggatcgtttgagctcagcagttcaagaccagcctgggcatcatagtgagaccctgtctctatttataaaaaaaaaatgaaaa

SEQ ID NO: 735916 - DNA, 1041 bp, Homo sapiens
ggcctcgcgaacgtgtatccctcggtatcatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcaagacctcgtctctactaaaaattaaaaaaaaaaaaaattagctgggcatggcggtggttcatgcctgtagtcctagcactttgggtgccagggcgggaggatcgtttgagctcagcagttcaagaccagcctgggcatcatagtgagaccctgtctctatttataaaaaaaaaatgaaaa

SEQ ID NO: 735917 - DNA, 2699 bp, Homo sapiens
caagcttggcacgaggatctcacatgtcctcagtgaacttgttctgatgcaggcagatgagcagctcttaatctgcctgaactctcaagtccccatttttttttctaaacaacagcaacagaagccaatttagcaataacccgcggcactggggctgcacataagttttgtccccaaatcctacttctgaaagtttattttgcgatatgacctcactagttacacagaacctgaacatgtcctcagcagcactgcatgtgatagttagaaaggacatgtaaaatattcttaaatatgatatgtattagataaattatacaactgctaaaaaagaatgaggcagaaaatgtgttgacacagaaaagctaacagtaagtgaaaaaggtgagctgtagcatgttgtatatgatatcgtatgtaatatatgtgttgtatatgcctttataaccataaaccatgtctggcagaatacacagaaactattaacagattacccaggagtgggactcgggggtaagtgaggttatagagagagaggcttactttttgctttgtacttttttgtattatttaaattagaaacaattaaaactaggaacatgattatttcataatttaaaaaataggagccacggggttagtgaataagctgttacgtgtcataatgaaccctcctgtttgtgtaacgaatcccatttacagtagtctgtaggcagacattgtgaagaaactagtagttctttctttctcctatatgcacctataggccggcagaaatatctagccctgaaaagtgaaatgaagcatgctttctgaatggttcatcatttactgtttccttccagtgaatggaagattttaacacaaaggagagtttgcaggcagatgttgagaagaagctagtagaagcttccaccttgttaatctttatgtatttatttagttatcaagtcatttgtcttgatattagttcatttaattatttaaatgaattaatgcctgtaatgtaggcagaagaaaaaaattcaattttaccattaactaaacataattttggaaacgctgagggatttcccagaacccaaagccagcctcttggctcctagtggccccgagcagccctggtgccctgcaaacccacccaccagctgccccacagaggatctcttctctcaaggagagggccattgttactcctccccaccagggaggcactggggatccttgattagggtttgggggagcaggaggaggtcccattgaggacacacaccagacttgtgctgagtaggggcttgggccacatgcagcactctcatgagatttgccaattcaccaaagcaaacccagatcaacactttgttgctctaatagggtgttgtgaccttcttcttctaattgttgaatatttaactgatgttaaaaatggtgattattgttgtaagcaatgaaaacacaataggcatataaatgggatatgtttgtatgtcagattaaatataacctataaatatgtctccccagccctgctctctaagagagaactctgttcacaattgagtctcctcctgctagtatttccccgtactcttagtaccactcctattactctcctttttgtcctgtctgtcaaagcatacaagttcccaggttcagaaatttaattctcctcttccgtcagttccctttcatagaagcaggttttccagtgaacactcgatttctttagtgcaaaagtgatctgtgtccttttttgtagaaaatgtaggaagtaggtttaagtaaaagaagaaaatacagcacacaacaggatttgggtttccaagctgctgaagtaggaaggggcatgccaaagtctgcagttccactcccttgtccccagccagacccaccctggtggccatccctgaagcaagagccaggacccccatctgccaggcaccaagaagcacttctccattgccaattaatttttttttctttttgagacagagtttcgctcttgtcgcccaggctggagtgcaatggtacaatctcagctcactgcagcctccacctcctgggttcaaccaattctcccacctcaacctcccaagtagctaggattacaggtgctcgccaccacacccagctaatttttgtatttttagtagagatggggtttcaccatgttggccaggctggtctcaaactcctgacgtcaggtaatccacccaccttggcctcccaaagtgctgggattacaggcatgagccaccatgcctggcccactgccaattaagtgtaaggggtggaggcccgagggagaacccaaggtctatttgccctaagccatcaatgccagggatggctccttgcccagaacaccttcccagatggaccagttaatgcttctggtgatgatgccatccgaatgctatactgaaagcccttcagccgaggatcaaggttctgcttgtatgcacggttgttgaaatgctatttaaaagtgccgtgccgtggtgtggtgtggggacctagagacctgggctttggggccaacagtaagaatttgaatcctgctgcttccacttgttagtcttgggcttgttgcttaaatctctctgcaattcactgtccttgtctgcaaaatgggaataattgttgttacagcactactagtagtaactgggcttaataaatactgaatagctgtggtc

SEQ ID NO: 735918 - DNA, 4734 bp, Homo sapiens
agtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggaggtgggctttgaagtgggcgtggagacggcgggggaggtggaggtgcgagtataaatgatcaaccagaaattatcttcaaaggaataaaaccagaagtatgtaaataaaaagcccaagataaagaaacagaaaagctgacactacatgaagcagagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgcaaaaaaaaact

SEQ ID NO: 735919 - DNA, 4579 bp, Homo sapiens
agtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgcaaaaaaaaact

SEQ ID NO: 735920 - DNA, 1717 bp, Homo sapiens
gtctcgcccaggcttgagtgtaaccggtgtggtcatagctcactacattctcaaactcctggccttaagtcatcctcctgcctcagcctcccaaaggcaagtaaggttaagaataggggaaaggtgaagtttcacagcttttctagaattctttttattcaagggactctcagatcatcaaacccacccagaatctgctcaattttcaagatttgcttataaatatttataatataaacactcaattgctatctgttttttaggttctcctctctctcccagaacagtggtaacaggaactcttgggggcttctccctgttcttgcagatgtggcaggatgtgttcctggggggctcccatgccagtccacaccctctgtggtgtaagcagggattggtaattaatgagatgctaaaccctccagaagtgagcgctcatgtcccagaaacacatcttccacctcagcagccagtgggaaaactagactttgtgtctgcatatttgttcttaaacacactcttctgcagtctaactctgctgaccactttccagtttgctcatatcagaatttcttcggttctaagatgcatattttctttttgtattctgacttgttagaaattagaatatgtcttgcagtcaataaaatctatgacaacatttttttttcttaatggttcctaaaactcctgtagttgatggtgtcttgcttaggtttaatgaaagagattttaatatatggcgtggttatgtggagttgtatctctatcagtattaatgggctcgggatgatttatattcaactgaacccccaaattcaacattttgtgttgaatatttattttatcagttattctttatcctgtactcattttggatacttactaaagtattgtatgtatttgttataataaaatggcttgccgtgtttgaacacactgtgtatctgacaatgttctaagacctaatttgatcttcatgacaactgcataaaatagttactattattctcaattcacaaatgagaaagtgagacacagagatgctaaggaattgcccaaagtcacacagctactgagtggcagagccagggtctgggcccagccagtgtggctccaggtgccgcccactcttgacgtgatacttaccgtcaatgctccttaccagttagggatgagctgattctcatatttttccaagatacattttaattttagctttatttgctgtatcatcatcatcagtatcatcatcatcatcagttttcttgttttaaaatagggtttggagtctcttcaaggctttctgttttggaaaagtaaaacttaaaaatctatagccatgtgaattatacttatggagaaaaagagtcttgttttattaacatcagacatctttgttcctactaattattttggagtaatgttcagtatcgggctaatgatcgatggatatcactcatccaattatgatgcatggattagaccacggccttaaactttgtacatagtgttgaataaattcatcttatttgcagtcttattgtcatctagctttgatacacttgccctttcatatgtctcttgtcactattctgtgtaagattataatcccaaataccactatatgtatttttcttcatattctattattgaacagtattaatgcttaatgttaatatataagtaatatatacattttaaaaattaaaaatgc

SEQ ID NO: 735921 - DNA, 1382 bp, Homo sapiens; identical to SEQ ID NO: 278006

SEQ ID NO: 735922 - DNA, 1026 bp, Homo sapiens; identical to SEQ ID NO: 277999

SEQ ID NO: 735923 - DNA, 1284 bp, Homo sapiens; identical to SEQ ID NO: 277997

SEQ ID NO: 735924 - DNA, 256 bp, Homo sapiens
gtagactattaagtcaaattcactactttggttttaaaaactcccttattttaaaatcttactgtctgccagactagtgtttttaaaataagctttaaaggagattaaacttaaggacccatctgtgaatcagcttgtgagattcaagtttgtacctatgcaaaattttaaattgctgcacatcacagatcttccctgtcactcaggtagtcaagactaataagagtactgaatccttgaatgccattgggtctgc

SEQ ID NO: 735925 - DNA, 622 bp, Homo sapiens
cttggttaatctgagcctactgtttctccttagataattcaccatacaataatgtactcaccatttgaatgaaacttgtttttagagccccattctgagacaactaaaccagctggttcatgcacaaagaataaaaattctaatggttctaaatctctcattaactgactgaatttctcattgtccttatcagtcatttcttcccattcacagcccccagccatccctcctcccaaagcagaatgcctattctgctaatgacatacctggaatatcaaaatcacttagttaagtctagagataaaagtaaatgttatctacattcctgcctaggcccagtccaacttgggccttcaagctcctgctaaagtgccacactatcccttaaacctctaaccctcacctggaagccacaccctttctgattgttctctacatataccatatgatgctgtccagatcttgaatcccttttttgtcccacatagaaagcattaagtagctgcggaattaatctgatgcatacttacctttccttgctgaatgaatgaatattcagaggctcttcttcctaaaatatggatagataaatgcagaaaggaatatatagcatcttcacatg

SEQ ID NO: 735926 - DNA, 543 bp, Homo sapiens
gttagaggtcaaatactaaaaggtttaaatatccaaagtactgacacttaggacttacctctaaagtctgactagctctaagttgtgaatgccccatcagcttggaccaccataacctggctacgagactgtgatagaatgcttgaagagctagcagaagtgtaaaaataaatagaaaaacagtgacactgtttctttacccaaaattaaccacagataaaatttaaaaatcacaaaagcactacacaagacacacttggcatatgtgtatatttgataactaaacacttacacatagtggcagagttttgtattcatttcaaaaattgcacagctcctttataagactctaaagggagcctctacattcacctaacgacataacgagacaactcacagaatgtaaatagagaccagttaaggtcataattaaattaaaaataacactgttttaaaataccatatgagccaggcccagtggctcacacctacaatcccagctactcaggaggccaaggtgggaggatcgcttgaggtcagaag

SEQ ID NO: 735927 - DNA, 223 bp, Homo sapiens
aactaggtttcttaatattctgaacactaaccttaaaatatggcacaactataaaaataattttgcatattagagaaagtcctctaaaagaacaattattttaatagattgacaggttaaattagagtttaagagtcacagttacataaaacccaatgaatctgatattctaaaacacatattgaaaaaatcaaaattcatgaaaactttagaaaaatcttac

SEQ ID NO: 735928 - DNA, 8011 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 735929 - DNA, 7776 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaagacagcaaccaaaagagcaaagaccccaaaag

SEQ ID NO: 735930 - DNA, 8615 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctagtcataagcaatcacgtaaatcattgtcaaaaataaaaatctaagcaggagggaattcaagatggctgactagatacattcagtgctcacctcttccacagaggggaaccaaaataatgagtagacaatcatacttcacgtagatctaacagagaacagtggaattcaacatgacaggaagcatcaaaagcaaggaagaaagcaaagcagcctgtcttgacaggattagctaggagtctacagaggctgcctaattggaggaaaaggaaagtgagcaatccccagcaatccacatgcccatcaaggactcctacaatcctaaccatcaaacagccccttgactcttgtgggtctcaagactaacagggcgttacctggagaccacatgaaagcactgctca

SEQ ID NO: 735931 - DNA, 9709 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccattctgttaaaacaccagaagcttattctttataactgtccaagaaaaatcaccaattatctttatatgatctgtgataaatcagtcctctaaacttttttccattttgctatttaggtaatataaccataagaaactaactcttaatacttgcaaatcttcatcaacaactagaaattatcttacttcaggaacttt

SEQ ID NO: 735932 - DNA, 9729 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccattctgttaaaacaccagaagcttattctttataacttcacagaaatttttgatttatgttcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735933 - DNA, 9696 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatcttcacagaaatttttgatttatgttcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735934 - DNA, 9677 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatcttcacagaaatttttgatttatgttcatatggagacaatattagcttggtttttccatccagtaattcagtttcaagctttaaaccatctctcgcactctctccacagaacgctcaagccccttgtgtacgtcggttgccgccgccgctcagcaagcgctacc

SEQ ID NO: 735935 - DNA, 9673 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatgcacacatatttcacaattcactgccaacaatgtattatatgtagtcgaaccacatcacgccctttgcattccagtatttgatatcctggttcagcactattatgcgtccacaggtggctagctcactctctctacatgggaccatgccgtcctgcagtc

SEQ ID NO: 735936 - DNA, 10045 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatctatttattgagtgatatttcgggtactccagcaacttcttcaccttaattaaacctgcaagtaaagccatcaagggcttagagttgaaggataaagtggtacatcatccaaactgggttctatccacagacaagcaaagactttaagacactgcaaagataaaagggggctgtagtaagttatggaagagaagagaaattcctactgatattaatctaaaaattaaaaaagaaataggtagcaagaagagtagaagtatcaaaacagttggctttttttgcttttgttttttgagaaggaattttccttgttccctcccatgcctagctggattgcagagttaagtttatgattatgaaataaaaactaaataacaaaaaaaaaaaaaaaaaaaaaaagaaaaatgcacagattttgatagaattaggaaagcactttgaccacatatatgttaaacttgatgataatgagatagagttcagctgtgtttaaagaacaaactatggagattacaataattcaacaagtggg

SEQ ID NO: 735937 - DNA, 9847 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatctatttattgagtgatatttcgggtactccagcaacttcttcaccttaattaaacctgcaagtaaagccatcaagggcttagagttgaaggataaagtggtacatcatccaaactgggttctatccacagacaagcaaagactttaagacacttcacagaaatttttgatttatgttcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735938 - DNA, 9767 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttcttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatctatttattgagtgatatttcgggtactccagcaacttcttcaccttaattaaacctgcaagtaaagccatcaagggcttagagttgaaggataaagtggtacatcatccaaactgggttctatccacagacaagcaaagactttaagacacttcacagaaatttttgatttatgttcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735939 - DNA, 9651 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttccctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735940 - DNA, 9788 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctttccttgctgaatgaatgaatattcagaggctcttcttcctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctgtttgcacaccagtatccttcttaggagaagtcgtagaattcatatatgtattcattttaccactgatttcatcagaatcatgtcttgaatttgaaatgttagatgcattatattccatttgtattgtatcaacaccaagatttttaatcagtctagaagtgtcatgtcccttttgcgccaattctcggattctttgttcttgttttagtctctgtgccagttcctgtgctcgctgcattgtctggaatagctcatttgtcttgagagtcatgatttcttccttttgtttttgcttaagtatgtcttcttcatactgtttctgcatctcttcacgttcctgtgctaagcgaagctcctcttcttgttcttccttctttctttgctcttcctccagttgtttcttcctgcgcttctcttctacctgggcagtgatggctttctgatgctctaattgtttttgtcgtcgtctgtctcgttcctcaatctgagctgggtccaagagagcagtcatagaacggagaaagtttgttttcttactgtttgccataaccacatccttaataggttttgctatatgctcctcctctgaaggttcaacctggcttccggttgtaggtgtacaaacactgctgacatcagccagctcctgagtgtcaggagagacacagaagtactcaggttgtttgtgtgttgaccgagagaacagctgagattgagaaccaggataactctttaatgaatcaaagtgcattgcccatctgtcatgttcctcaccctttgaatatataattttttcctctatttttctttgacggtcatcttctatttgcttattcaactcttcaatccattttctctgcagttcttgtttcacagcactgaaagggtgctccagcagtactgtttcctctaaagtctgactagctctaagttgtgaatgccccatcagcttggaccaccataacctggctacgagactgtgatagaatgcttgaagagcctagattggtcaagaatttgatgtttttcccatattattttatcactttcagattttttccaaggatcattccatttttcagaaacttctttttctttcttctttaaagcaacctgttcatctagctctttcctccactgggctttttttgcttccaacgaacttctatcacattccctttcccccagagtactgaatatatcagctggtttccattcattctctatggcaattttttgctcacactgtttagatgtctcctgatgttcatttaagacagatttattttcagctgggacagatgaaaccatttcagtttttttgaataatcccataatgttctcatcctttggctgattagaaatactgtttaaatatagactatattgactttttgcctcctttccattctcagtcagggaaagagatctatttccttggtttacagtcatcaaaatctgttgtagttggtcttgtgttagacacaccaaactgctcttcatgttttcagctgtgatgtgttttttgtgaggcttctgtttacctactagagatgtatttacggtgtttctagtcttctgcatattaggagttgcaggtgaaatctctttctggatatgaagacagtctttatctatacattgtttacataaatccttagtggatgaaaaagtcattccatttttttcaccttttgcctgtgatgtttctgaaccaactggcttcttttgcaaaagtttttcactcccaatacaagtatcttgtgttgattttagaatgtgcccagtttttgttcttaaaggacattttgcaatcttggccttatttcccatcttcacagaaatttttgatttatgttcatatggagacaatattagcttggtttttccatccagtaattcagtttcaagctttaaaccatctcccaagttcatggcctgacctcgcactctctccacagaacgctcaagccccttgtgtacgtcggttgccgccgccgctcagcaagcgctacc

SEQ ID NO: 735941 - DNA, 1161 bp, Homo sapiens
  misc_feature (913)..(913): n is a, c, g, or t
  misc_feature (927)..(927): n is a, c, g, or t
gtaaaggatttaatattacctcttctaggagaattaacattttagaacagtagcctgcagagggcaatgtttaacccaatgaagaggctcaaattgtggactgtcaggcactgtgataagtggtagattcatggagacacaagataatcatgaccctcattgtcttactatttaagtcaccacacctttcacttattaggcatgggccacctgacttcacttttcatgaagagtagggcaagaaaagcataatggcccatatttcaagcaactggtcccaaaacacacaagctgaacaaaggaggaaacgcagacagtggggtggctggcctcttgattcacccctatcttgccctctccagcagcattccaggcaagtgccatcagctctatttattcttattccttcacacccacctagggccttaacatcactgatgaggaaatttgaaccccaaaggagttgacttagtagttgtcctggtaccagagcccagtctggctctataactcctagctgagaagttcctgctatgtcccaagggacactgctcccatttattggagcttcccctagggattgtgagggatgagaatattagactagagatggaaagaattaaaaccaaacaatgtgaaaatccaaacccaggacccaaccagaattggagaccaaagagctcattttccttatttgctcctctttttcaactggtcctcaaaacatgagtgttttcctggaccagttcttagctctcttctttcctatttcaacactttccttacagagtgcattcattgccaggccttcagctattattcctacgtagatggcttctaagtcagacagccccatggttctaatgaatacccccatatggatgtcccaccaccattccaaatacagtctgtntaaaatcaaatcanccttccatatttctggtaatagcaacattatttgattccctggattcatctaagtaactacagctctgtgggattcacttttgcttcttcccaccccacacatccaggctgtcacttagacttgttgaatcttattgtaattcttcagggtcttctctactctcattcacggtacattgttccaggttacgtattataatctttagcttgtgagctcaacttcagtggggattt

SEQ ID NO: 735942 - DNA, 2145 bp, Homo sapiens
aaaaaaatattgtattgtttttaccctgatttgattatcagtattttaggttaatttgtaagagaaaaatcaagtaatgctgtaaaagctcatgtaaatcacagaaaagaactgttttaatgacttttgtttgcttttaataacatcaaggtattagaatttattaattgccatttttatgaaagtattaataaaattgtttgctacaatgatatttctgaagccacagtttgttaaatatatttgtctttccattatttttcagaaaaatataaagcagtaaccaaactgatcatttcacccagatttgagggtaagatatagctttagcctactgtttatattcaacttaactgctaaatctctgttaaaaaaaaacgctttctttagaaacatattttcaatctgtgttccttcccactggcagcccctttggagaagagtctgacagtgccaagatcaacatgctttgattcttgcccattcttttgaatcagttggattctgacataacttcagataagcaaatactaatattcagtcttaactatctgctcaaatacttttagaaacccttcagtacctctgtattccattgccagtttgcctggttacaggttagttacccacttatggagtgaattgtgatttgtatttggttcttttaaagatgaccaaaattatcaatccatgactttacccaaattattactgttgtggaaaatgaactaattgcattacggttaacttgagggcagaaatgaatgtaactgactatattgaccaatacagtgggtttaaggttcatatatttatggtaagaaaagtaaacacagaaacagagagagagagagaatataaattaagattgttgttgctttacacgtatacataggtatgctgaaggtgtgaacagtatagatagcatatgcaagtacttttagactaaatgccttatgcatctgaggagatacaccgtaggattgtgttattttatttatttatgagtactgagcacagagctttgggttccagccacttctgttatgtagacaagtggcatcaaatcaaggtttggcatcatttctagtgctcatcccattagtcactgtggtcagatgggctgaactaaaataaaatatcctgtttgtggcttcacttacctagaataactggtgacatatatcaagttcacctgataattgttaactctcaatttcagatttcctaaggatctattctttgttaatttaaaagctaatgggaactcaaatgaattttaataacttactttgtacaaaactgcccttaatctaatttggaattttattttgttttatttatttatttatttatttatttaatgtctttttagtttctactggttgataggattgtgttttaaaagggaaaatcgaggaagggaaattgtgttgtttatcttataggaaatgatggttttttttaatttttaaaaattattttaacctgttgttcttatgtctacaaggggaaaataaagtagggctctgaggcatttgaatattttagaccaaataattgctattgagaataaagattcaagcttctcattaatccataattgacatttccactgactgtaggacccagaaccaggagagaattactcaaccctccacttcagtttacttttgtagacactgcctaaatagaaatagaaattctggtgatttcaataacatcaaaaatgacaaattacctgtttaacttaaaaaggtcatgaatgaggccttcagagaaataatattaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtcaaaaaaaaaac

SEQ ID NO: 735943 - DNA, 381 bp, Homo sapiens
gctttttaaatgacccaggcgtgtgtaataatataatgaataaccatagagcagtgcctttaaattagctataggaaggaaatagtcttttcaagtttctgaacaatatatttctcttagttggcacctcacaaatactagatcatgtcagacgctgctggttaatagctgcaggaaggcatgttgtgcagtggatattgctcatggaagtgtgtgaaaatcatagtaagctttgttctccctgctaagacttgctatgtatatttccatcattgtttcatgtaaactgaaccattgtggtaaacttttggagttgatatggaatcactttaatgctgttttcacaaataaaagttttttcttataggtcaaaaaaaaaac

SEQ ID NO: 735944 - DNA, 1401 bp, Homo sapiens
  misc_feature (48)..(48): n is a, c, g, or t
gaacatgccgtggctcggtgctagagtcatagcgggcacttctgtgtngtccgttgtcatcgcagtgtctgctctgcgggtgctggggcctgtgttggttaagactgacttggtgggggacgctgatgatgggggaggctgtgagtggtggggatgggaactccagactctccactgcagcttttttttttttgaaacacagtttcacttttgttgcccaggccagagcgcaacggtgcgatctcagctcactgcaaactccacctcccaggttcaagcaattctcctgcctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctacctgtgcctccttcctctacccccaaactcctttccctttgagtgagacctgcctaatttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagatttcagtggaatccaattgcttatcaaatcaaggcagggtaaagggttggactttgtttaacaggccacctccaacctcccttttctactatttccatgctttctatgctttagacaaagaactcattgtttta

SEQ ID NO: 735945 - DNA, 587 bp, Homo sapiens
aatgtgtacaaaccagtgagatttgttccaacacactataaactttcaaggagagaggctgtgtcttcttcatgtttatatctgctgcaacactgagttcatggcttttcacacataattgctcaacagagcaggtgccatggaaagtcaattcaatgagtaaaattacctcaaaatagtccgttaattcactcacctttgatgtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagg

SEQ ID NO: 735946 - DNA, 806 bp, Homo sapiens
  misc_feature (592)..(592): n is a, c, g, or t
agaattatcaaaggatggctgtacagaccacctagaaaataattcagtatttcaggtttttcttttctgggagtgtgataactgaaattgttagattttggctcagttaagaaaagaaagatctgttgcctttcttctgagtgaacagtggtgagaaaaaattttgcaaggccccgcttttcctttcttcacaggccagcagtagccatatctgatcaaaaaagatacctgaaggaatattgatcacattttcctgaggccctagcaagcacaggaattgagaagttaggactggaacaactttgtcatttgtcacaattgccaaacattagaatacacaggaaccgttttttcaggtaactctgtgacttggctggatcttcctgatcatcaagattagcacctcggggcctggaagaggttagggagggcaggaagaaggagtgagccagcatccagctctgcgtggggcaggctatggcgtggacagacttaacattccacagcacggctgaaagccctggacctctttcccttgcacccctaattcatggtgataaaaccaaaacatggtgaattaggttattagaangttggaacatctctgaagctcaaagccctcttatggctatgtgaaggcatacgtggaggcatacgtactccaccctgaagcttctccttcaattttaatgttaatcttaccaagcgacagctttcatcctggttaaggcagctcggtgtgtgtaaaagcagcctggcctgttaaacacaatgccgttaaatcaaactgcctttctttttttttt

SEQ ID NO: 735947 - DNA, 542 bp, Homo sapiens
taatgccttttggtaaccagaagacttttttatttcaaaaatgtctagacattataatgctttatcttgcactccaaacatattggcaacaaatattaactttgaatattgcccacagtcctggatagttttatttaaaacatcccagatatggattgaatagcccttggtaaaggtgaatttggttaaacattgagcccgctcctgaaattcacttgggcattctggaagtcttcagcccagatccaaagggtatcatttagcaagccactataagagttatagcttctgaagacataatttaaacaaggattagtttgggcactggaagagtcaagcactttggagtttagaatctgacaagcagcagctaagctactgaaagatgagagccttgtgggcatttatctgatggtttttcaaacaggcagccagattaactacaatcatcgtttgaaatctttaagaaagcaaaaggccttctgaaaacattgcttttggtttctctacctccaagttgtcagtactgaaaaggaaacttt

SEQ ID NO: 735948 - DNA, 7765 bp, Homo sapiens
ccaaccaaatctcggcccccccgccctagccataactgcacaaaaaagggtcaaggcacggaatttttcaaatacgggacccacgcgtccgcttccgatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735949 - DNA, 5607 bp, Homo sapiens
ccctcaggacgtacttgtcaagggtggaagtccaagtgattgagggagggagaaggtgcctggatagttctgttcctcttctccatccctcctcttgcagcaccacctctgggtccagtactccctatactccacccacactcacactaccccacttctgtctaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735950 - DNA, 6049 bp, Homo sapiens
aattttcagatatcgtcgaccacgcgtccgtttggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735951 - DNA, 3899 bp, Homo sapiens
cacgaggtttttttttgcatggtgagaagattttttatttgaaatatagtctgagcaacatgagtgtagccaagaggagtaggggctggcctgcctggggcagcagcctctcaaatggcacgagagcagtacaaatattccaatgtctgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735952 - DNA, 3895 bp, Homo sapiens
aaggatccccgtgtgcagccaacaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735953 - DNA, 7683 bp, Homo sapiens
cggcggggcccgtgtctggtatagtaggcggcaggctgccgctactactaccaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735954 - DNA, 2996 bp, Homo sapiens; identical to SEQ ID NO: 449091

SEQ ID NO: 735955 - DNA, 8411 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735956 - DNA, 5420 bp, Homo sapiens; identical to SEQ ID NO: 449094

SEQ ID NO: 735957 - DNA, 8222 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacaagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgcaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 735958 - DNA, 3808 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatgagtgcacaagtgaacctccggcgaatgaag

SEQ ID NO: 735959 - DNA, 3340 bp, Homo sapiens
  misc_feature (3315)..(3315): n is a, c, g, or t
  misc_feature (3340)..(3340): n is a, c, g, or t
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagacaccacgngtccgaatgtgacactgcagctcan

SEQ ID NO: 735960 - DNA, 2765 bp, Homo sapiens; identical to SEQ ID NO: 449095

SEQ ID NO: 735961 - DNA, 1309 bp, Homo sapiens
gaggcatagatctcctcctctctgaatcccatgcccccatcagccacataccacatagggaggccacagatgggccgtggtgggtggtggtagcctttgcaccatggtgagcagagacggctggctctcctcagggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcggtcagtatggctagaccctctgcagaacccttcctcacttcaatctgaccctgcactttcattcatttattcattcattcattcatttgttcattccacaaacagttgttaagtgaaggtatcatagcactaaggttcagagaatggatttgagggatcaggcagacctaggctttaatctggtgccgtcattctagctgtgtgactttgggtaagttacttgttctctctgggcctcaatttcttcatttctaaaaggaagtaatggatgatgtaatgaatcatatccacctcatagtttatgagagagttaaatgaaggctgggcgcgtggtgtctcacacctgtaatcccaacactttgggaagcaaggtgggcgggtcatctaaggccaggagtttgagactagcctggccaacatggtgaaacccagcctctactaaaaatacaaaaattagcctggcatggtggtacataccagtaatctcagctactcaggaggctgaggcacgagaatcgcttgagcacaggaggtggaggttgcagtgagccaagattgtaccacttcactccagcctgggtgacagagggagatcttgtctca

SEQ ID NO: 735962 - DNA, 5374 bp, Homo sapiens
ctgggacgagcggcgggcacccgctgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagactaccattctcattcattcattcaacaaatatgtattgtgcacctaattggtgccaggtctggggatatagcatgaacaaaacaaacagggcccctgctcttatgaatcctccgttgtggaggg

SEQ ID NO: 735963 - DNA, 5573 bp, Homo sapiens
ctgggacgagcggcgggcacccgctgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagacaaaaaaaaaaaaaaacaacaacgtgtgtgtgcgggcggcctttgggccctcgcgaagaaaagcttttttcaacaacacttcgcggtgggggcggcgcgggggcggcccccccagcagggttaggtgcaacaccggtggctccaagagcgggttccccagagggaaaatcgcgggccagagaacaagggccggggcatctcccccccattaaaaagcgccgcgggcgaacgcggagcgttcggaaacaatcccaggaggggctccgggaggcacatccggggtctatacgcgggcgttcccaggcgactcgctttcaatcagc

SEQ ID NO: 735964 - DNA, 5651 bp, Homo sapiens
ctgggacgagcggcgggcacccgctgagcggacggcggccgcgtagtgaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagacaaaaaaaaaaaaaaacaacaacgtgtgtgtgcgggcggcctttgggccctcgcgaagaaaagcttttttcaacaacacttcgcggtgggggcggcgcgggggcggcccccccagcagggttaggtgcaacaccggtggctccaagagcgggttccccagagggaaaatcgcgggccagagaacaagggccggggcatctcccccccattaaaaagcgccgcgggcgaacgcggagcgttcggaaacaatcccaggaggggctccgggaggcacatccggggtctatacgcgggcgttcccaggcgactcgctttcaatcagc

SEQ ID NO: 735965 - DNA, 5947 bp, Homo sapiens
gagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagacaaaaaaaaaaaaaaacaacaacgtgtgtgtgcgggcggcctttgggccctcgcgaagaaaagcttttttcaacaacacttcgcggtgggggcggcgcgggggcggcccccccagcagggttaggtgcaacaccggtggctccaagagcgggttccccagagggaaaatcgcgggccagagaacaagggccggggcatctcccccccattaaaaagcgccgcgggcgaacgcggagcgttcggaaacaatcccaggaggggctccgggaggcacatccggggtctatacgcgggcgttcccaggcgactcgctttcaatcagc

SEQ ID NO: 735966 - DNA, 4584 bp, Homo sapiens
gagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcttgctcctccacagacccctgggatgacttcattggaaagaacatggacagggt

SEQ ID NO: 735967 - DNA, 4769 bp, Homo sapiens
  misc_feature (4474)..(4474): n is a, c, g, or t
  misc_feature (4478)..(4478): n is a, c, g, or t
  misc_feature (4501)..(4501): n is a, c, g, or t
  misc_feature (4634)..(4634): n is a, c, g, or t
  misc_feature (4636)..(4637): n is a, c, g, or t
  misc_feature (4648)..(4648): n is a, c, g, or t
  misc_feature (4661)..(4661): n is a, c, g, or t
  misc_feature (4663)..(4663): n is a, c, g, or t
gagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctcgtacacaggctggctgncaanatgccatccagactgaggaaganccggaaacttaggggctacgtgagccacggcaggcgcataggcaagcacggaagcacccggcggcgcggtaatgctggtggtctgcatcacagcggatcaattcgacaaaatacaccaggtattgggaaagtngnntgaagcttacnttagagaacgagntntgccaatgtcactgcaatgggttggcctgacgccggtgagtctaaacaaggggcccctggggggggggttatggagggcccagggggattaaaggaaagggggggg

SEQ ID NO: 735968 - DNA, 4433 bp, Homo sapiens
gagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcgtaccgtaattcgtgtgag

SEQ ID NO: 735969 - DNA, 5898 bp, Homo sapiens
  misc_feature (5889)..(5890): n is a, c, g, or t
  misc_feature (5892)..(5892): n is a, c, g, or t
  misc_feature (5894)..(5897): n is a, c, g, or t
gagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggccccctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagacaaaaaaaaaaaaaaacaacaacgtgtgtgtgcgggcggcctttgggccctcgcgaagaaaagcttttttcaacaacacttcgcggtgggggcggcgcgggggcggcccccccagcagggttaggtgcaacaccggtggctccaagagcgggttccccagagggaaaatcgcgggccagagaacaagggccggggcatctcccccccattaaaaagcgccgcgggcgaacgcggagcgttcggaaacaatcccaggaggggctccgggaggcacatccggggtctatacgcgggcgttcccaggcgactcgctttcaatcagccnntngnnnng

SEQ ID NO: 735970 - DNA, 548 bp, Homo sapiens
tatttttttgtttgtacaataaaggacataataagagtagtgtccatgactaattaaaaatgcgattctgactggctcaaccccatgagctctatgcttccttatattttcacgtaactgttctctcacaatgctgctttttgtcacatgattctacaatattaatctcataaagctgtgctgcctaacatggtagtcacagatcacacatggctattgaaatttaaatcagttaaatgtgaaaagtcacttcctctagccaaatctgaagagctcaatagctatatgcagcaagacactaaactgtattgggtagcacagatatagaaatttctattattcgagaatgttctattggatggcactgtacaatggatttagaaactaagactgacccacttactttcttcttttaaaccacccatactaagatcaagactcccagcaacaacaggtaccattacatgtcatgtgccacgcactgaactaagcccttagtgtatattatctcatcaaatctttgtaataagctcatgttatcattaaga

SEQ ID NO: 735971 - DNA, 1462 bp, Homo sapiens
cggaagaggaggcctgatggggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactctctgctccactggcacagaatagggcatggagcctggtgctgggtgtcagcccatggtgttgggtgtcagttcacaggctgggtaagggagggaaaataatccattctttgatattagacatgacccaaaatttcctgctggcagccaaaggcctcctcgctcagagaagtcatctgaaaaaagctagcccaggggcaggaaagggcctcaggctggcgccccagaaggtggcccatcagtcactctgggaagacagatagacatcgtcagtctctttttacaagtcaagacagtaaaatcaaagtaatagtttcctggcaggaagaaagagaattgctggagcgttggagagccatctcttaacctctggggtgactcaaaggaagagttgcctggtctgagaactttagaccaaagaatttaaatcatgtgaactgaaaatgcatgtgtatccatatatacatgtacatatatgtttatatacccaatatagaaaggttaccagagacaaagaaatagcaacaatagttgttttggggaagggaaaggaagggctgtggggtgaggaagcatactttcactgaatatcctctgtactgtgtgcatttttgccacatgcatgaactaaacctacaagaaaataaacaaataaaaaaaaagaacaca

SEQ ID NO: 735972 - DNA, 1557 bp, Homo sapiens
ctccacccgacggggtggagtggggtctgaaggctgagaagggagccaagggccagctcagcagcacacacaacaccagggcagttagcttgtttctctcttcccctgtcgcacaggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactctctgctccactggcacagaatagggcatggagcctggtgctgggtgtcagcccatggtgttgggtgtcagttcacaggctgggtaagggagggaaaataatccattctttgatattagacatgacccaaaatttcctgctggcagccaaaggcctcctcgctcagagaagtcatctgaaaaaagctagcccaggggcaggaaagggcctcaggctggcgccccagaaggtggcccatcagtcactctgggaagacagatagacatcgtcagtctctttttacaagtcaagacagtaaaatcaaagtaatagtttcctggcaggaagaaagagaattgctggagcgttggagagccatctcttaacctctggggtgactcaaaggaagagttgcctggtctgagaactttagaccaaagaatttaaatcatgtgaactgaaaatgcatgtgtatccatatatacatgtacatatatgtttatatacccaatatagaaaggttaccagagacaaagaaatagcaacaatagttgttttggggaagggaaaggaagggctgtggggtgaggaagcatactttcactgaatatcctctgtactgtgtgcatttttgccacatgcatgaactaaacctacaagaaaataaacaaataaaaaaaaagaacaca

SEQ ID NO: 735973 - DNA, 3118 bp, Homo sapiens
aattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcggatcatttgaggtcaggagtttgagaccagcctggccaacatggtgaaaccctgtgtctactaaaaatacaaaaaaaattggctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 735974 - DNA, 1191 bp, Homo sapiens
gcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacct

SEQ ID NO: 735975 - DNA, 448 bp, Homo sapiens; identical to SEQ ID NO: 95132

SEQ ID NO: 735976 - DNA, 851 bp, Homo sapiens
  misc_feature (757)..(757): n is a, c, g, or t
caaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgcatcttcttgccaaatcttctggagcgcttgtaatttcctctgtacagagcccaacaggctcatcagcagcagaagaaactgcctcattgggagccaggacttgtgatgatgatcttacagagcagcagttgagatcaacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagngcctgtccctgatgtgatgatgccaaacagtatgctactgccagcagctgcctctgagaaatcagagcgggacacacctgcagccgtgacagct

SEQ ID NO: 735977 - DNA, 1339 bp, Homo sapiens
gtagagatgggcgggggcggcgggggggtcttactatgttgctcaggctggtcttgaactcctggcctcaagtgatccttggccttggcctcccaaagcactaacattacaggtttgagccatcatgcccagccagtaaataaaatttacttggaacagttatacctactcatttaagtctatggctgcttttgcattataagggcagaggcagagttgagccgtcacaacagagattatgtagtacgcaaagctaaaaatatataccatctgattcttcacagaaaaagtttgctgaccctagtctagaggacaagaagattcaaatatccacaactgtcggcactgtggtacaatataatgagtcaacaattttctataacacaggtacatcttttgcagggcagtcaaggtaccatcaaggatcttttgaatatgtgtcaaccttctagtaatttttcagactacaactcccagtaaatgctaggccaagagcttgggagtggggaaagatgaggaggccagataggcatgcaatggtgtgatcctttcagggaggcgtggctcccaatcaattagtcaatcaaccaaacaaccaatggagtgataggaaatctttctttgtactcccacagttatagaagattctagtttagtccaacagatgtgaaacagaaaaataatctattttagtatctagaatctaaacattagactctggctcaaaagctatgcacataacccaccctccctatagatctcagaaagggattctaccggcatccaaataaagaccaggtgaggtcaaggataaaccacatatattttctttgttgataaacagcatatctggctaaataaatacatcaggttaatggagaaaaaaaggtgataagaacatatatccataatacattctgggcaaatcaagtaatgcatcataaaaattaatgttggaaatatagaaatatatagaaagttagtgggatatgacttaagggacatcatttaagaaagaaaagaaaattggtgggagaacaagttatctcatgatatttaacagtacagtaataatacatttttaaaaccccaacaacagtatctaccaaattaacatttacttgagtttcactgattttgtggctctcttggtttggctgtagaattgtgcaagagcacaagaatttatagctggtttttgtttatacatatttaaataatattataataaatataatttaaatcaatattggaatttgtagggattttttccccttaaatggacccaaacattgtgaaggtctgtgaaacatcatttatagttacaaaatataatttc

SEQ ID NO: 735978 - DNA, 1347 bp, Homo sapiens
tggagacagggtcttgctctgttgcttgggctagagtgcagtggcacaaccatggctcactgaagtcttcccaggctcaatgatccttggccttggcctcccaaagcactaacattacaggtttgagccatcatgcccagccagtaaataaaatttacttggaacagttatacctactcatttaagtctatggctgcttttgcattataagggcagaggcagagttgagccgtcacaacagagattatgtagtacgcaaagctaaaaatatataccatctgattcttcacagaaaaagtttgctgaccctagtctagaggacaagaagattcaaatatccacaactgtcggcactgtggtacaatataatgagtcaacaattttctataacacaggtacatcttttgcagggcagtcaaggtaccatcaaggatcttttgaatatgtgtcaaccttctagtaatttttcagactacaactcccagtaaatgctaggccaagagcttgggagtggggaaagatgaggaggccagataggcatgcaatggtgtgatcctttcagggaggcgtggctcccaatcaattagtcaatcaaccaaacaaccaatggagtgataggaaatctttctttgtactcccacagttatagaagattctagtttagtccaacagatgtgaaacagaaaaataatctattttagtatctagaatctaaacattagactctggctcaaaagctatgcacataacccaccctccctatagatctcagaaagggattctaccggcatccaaataaagaccaggtgaggtcaaggataaaccacatatattttctttgttgataaacagcatatctggctaaataaatacatcaggttaatggagaaaaaaaggtgataagaacatatatccataatacattctgggcaaatcaagtaatgcatcataaaaattaatgttggaaatatagaaatatatagaaagttagtgggatatgacttaagggacatcatttaagaaagaaaagaaaattggtgggagaacaagttatctcatgatatttaacagtacagtaataatacatttttaaaaccccaacaacagtatctaccaaattaacatttacttgagtttcactgattttgtggctctcttggtttggctgtagaattgtgcaagagcacaagaatttatagctggtttttgtttatacatatttaaataatattataataaatataatttaaatcaatattggaatttgtagggattttttccccttaaatggacccaaacattgtgaaggtctgtgaaacatcatttatagttacaaaatataatttc

SEQ ID NO: 735979 - DNA, 444 bp, Homo sapiens
tggagacagggtcttgctctgttgcttgggctagagtgcagtggcacaaccatggctcactgaagtcttcccaggctcaagtgatcctcccacctcagccagcgtgcactaccatacctggctaatttttaataaattttttgtagagacagggtctcagttgttgcccagtctgatctcaaactcccgcactcaatcctctcgcctcagcatcccaaagtgctaggattgcaggcgtgagccactgagcctgatcaagacaaattctccaatcaaatgccagaatctggaatgagaaatgtaatcagcgacctgaaagcagtttggggagcgtggaaaagacaacaaacttgactgcttagaacaggggtatacaaactctggcctgcatgacaaatccagctgccacctgtctttgtaaataaaactgttttgctttctttg

SEQ ID NO: 735980 - DNA, 1006 bp, Homo sapiens
gggaaattgatgagttgaattcagaagacctggttctaatcctaactgtgctctctaattgccgagcacaccctgagcatgtcctttgacttctcagggcctcacttttcccacctttcaattttatgaattttaaatattccaccaataatttctagcatgatatccattgttaatatccactatctaaccagaccccagatttacgtaagcttgttttaaaatttgggcaggagggttaggtgccctgctgtgccccatagctcatggcacagtgacatcatctgtctattcaaaagcccttttcttagtccatgaaatcatccttggtggcaaatcgaatcatatgaggagttttagaaattcccaacaaccagacggtacctcagaccagtaaaatgagaatctctcagttgggacccaggcattggtcactcttagacccatttaattatctactcattttcccctcacaaccctgtcatcactcattcccgcccccttcaaaggcaggagctctgtgggattggacacagggactgaagttgagcaaatcatcttgatagcacgtggctttgctgtgtgtggttaatcaaccgatatgaacagtgctgacctgtagccctgccacatccccgcagtgagagcaagacaaggcacaggagagctgatcccaacacatatctaagcccatgggtcacagcaggtttcaaccatttagagaagaattttggattcttcattgttgcctgttcttatcaatgttactgattcattcagttcattcattcaacagatgtattttcagttttctgctaatatgccagacacagtgtaccagagactctgtggagggcagaaattaaccaggtggagggaagagcattctgggagatgggaatagcaggtgcaaaggcctggcaaataggagtctggcggaggttgcagtgagctgcgatcacaccactgcactccaccctgggcaacagagtgagactctgtctca

SEQ ID NO: 735981 - DNA, 1081 bp, Homo sapiens
ataaatggaaacagacctggcaagtaagacatctctgatttggaggatatattttttagtctacaaagaatccttgaatacatcaagatagagcatatcttacaaacatatgggcaaccatatgacatcatcctgtgtcactactagttttggtcatgtgaatccaaagggccctttggtgatgttactcaccaatacacttcccagtcatataaaattagataccttcccatccttaaccacttttagtagaaagaatgcccttcagtccacactgtgttactaggcccaaagcagtgttactagtagtctatttcttacagcatacaaaactgctctgtatcagtttgccagggctgtcataacaaagtaccacagactgtggcttaaacaacagaaataacaaagtagcacagactgtggcttaaacaacagaaatttattttccacaattctggaggccgaaagtctgagatcaaggaggcagcaaaggtggtttcttctgaggcctttctccttggcttgtagatgccattatctccctgtgtcttaatatggtcttccctctctgcatgtctgtgtcctaattcctctttttatgagaacaccagtcatattgcattagggcccaccctaatgacctcattttaactcgattctttaaagaccctgtcccccaaatacagtcacattctgaggtactgggaagttgtaacttcaatgcagaagctttagaggcacacaatttatcccacaacatgtcacttgcaagacttgctgtgctgttgcatatttagaaaaggaaaggtggtcagtaggcaagctgagaacacatgttaaactgcatcattcatggatcttgattgaaatcccttatttatgaaacaagcttgtatgtacactttgagtctgttaaatattatggtgaaattccatttatgcagtgggtcacacccaagacttcctgaaaggttagaggtgacccttgctcctaagttggggcctaaatcttggcagtcataaaaaagtatttcttaactaggctatacaatcaacattctcaattttattgaaaaaaaaa

SEQ ID NO: 735982 - DNA, 484 bp, Homo sapiens
gtcagttcatccaaaggcagctagagaggcagctcagcaagtatctcagaaaggctaagtcatatatgttctcaaactagcccttttttttcctcccatcttctgaaaaccactatggagatttttctccacattttatttctaaaaaattttaaacacatatcaaagctggaagaattgtatagtaaacaaactgtataccccaaactggattcttctgctaacatttttctgtgttgctatatcacatatctatccacatatgcatacctctatttatctttcgtcaagccatcttatgtttctgatgcatttcaaagtaaatagctgacatcagtaagacatctacctaaatattttattctgttttgttaaaatttacatacaaaaacatgcataatcttaagggtaccattccatgtattttgaaaagtgtacacatctgtgtaactaaacccccaataaaattgccatcacctcagaa

SEQ ID NO: 735983 - DNA, 533 bp, Homo sapiens; identical to SEQ ID NO: 4128

SEQ ID NO: 735984 - DNA, 2014 bp, Homo sapiens
gacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagt

SEQ ID NO: 735985 - DNA, 1065 bp, Homo sapiens; identical to SEQ ID NO: 4126

SEQ ID NO: 735986 - DNA, 1033 bp, Homo sapiens
  misc_feature (559)..(559): n is a, c, g, or t
  misc_feature (575)..(575): n is a, c, g, or t
gaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctntggtcccagctacttnggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttgg

SEQ ID NO: 735987 - DNA, 659 bp, Homo sapiens
  misc_feature (466)..(466): n is a, c, g, or t
  misc_feature (597)..(597): n is a, c, g, or t
  misc_feature (639)..(639): n is a, c, g, or t
tatttcttttattttcaaagcctaggattgagccagtaacaaattgcctaacataaatcagcattatggaacttctgtctctctattctcaactctttttgccttatattataagaaaacgtaaaaggagtcagaagaaaagcagagagcttgcagaaatagcttgccactagcaacttaattcagcccccaaaataggaaattcacagctggttaaacatctgtgggccactggcggctgagaatgttcaaacacttaaactgtgttttccagatcaagccaatccagaagtctttaaatcaccataataaccagagaatagaacttccctggctggctgtgggctctttgggtacagttagctcgtaccctcagctgctcagagtggccccagggcctgctggactctcagggcctggtgctggcatctgtgtttccctcaggctcctctgcaggacatgcccncgctgctgggagtggttctgctgccggtccccaccgaagtctgggcaccacgccggctgatgaccatctgggcacagcctgcagtcacctcctctccccagagcggaatcctgagggaggcgccacctggntcccgctgctttcctctaaaggaatcggtcggtgttccatgnagaggaaaagggagaggaaa

SEQ ID NO: 735988 - DNA, 636 bp, Homo sapiens
gccaccactggaggatagaggtgtgtcctctttaagtattcaatttgccaaactcccaaagggattaaagcacttaaatttatctaaaacctcattatcacctaaaggggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaagtgagtggttaattcactttctccagagcttttaaagttcaacttatttttacgaatgtgcttgagggaagggagaaagatatataatccaaagacaaaaaccacagatgagaatgcctttttactctggggcagaaaaataaattaaaattttaaaaagtacat

SEQ ID NO: 735989 - DNA, 2430 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaa

SEQ ID NO: 735990 - DNA, 915 bp, Homo sapiens
ttcccccccccccccccctctaacgacgccatgatcgagctcgtacccggggttgttggttagattaccgaagaagactaaattcatgtgtaacagtgcagattatttaattgtatcacaaaatgtaaaattgcatgcatggtttgatggaaacatttctcacatttatgtcttctaacacacgtgggtaaagaatcagtaactgccaatgaatgagatagcataaaattttgactttcataaaacaaaacttgtaaatcatttctgaaatttataaggtttccagctgacaattttctgccaagttaacatttcaaaaatgaaaaacaaaatcaatgtgtattttagagtatcatctagatctgcgcccctttgtaaatggattctatggtggttaagtcatctagaaacaccctgggagcaaggttccatcctactacttcctaattacatctgatctgctttatttttgtgtcctctttatactagctgtttctaactggggggcggttatggaatgtttcttagtgacagctggggcctgccaatctcattcattgttttctacttctgcacagtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaagccctaacaaacgccacctattaaaggccctaagggccagaacacttttcccctttgccaacttttcaaaccaaaccttcgtgccccccaatttcccccctcactcggcaaaccgcaattttcattcaatgtacgggcggccccgctttttttttctc

SEQ ID NO: 735991 - DNA, 698 bp, Homo sapiens
acattttttgcttgtttacattatttttattttgttttaaattatatatatacaaattagtaaactcaactctcccaaatatttgttagttcaacaataaaacagaaactcataacaaataagaaatcagatagaaaaactgttagaaacaagggatacatctgatattttagactcttcaaagagggggttgtttctttctgcttctgctaagttctcagtcttgatgggatgattaaaatgtaggataaggtcacaaagcaataactgggagagcttatttggtgcctaacgaacggccatgccctcttcttcttggagtcacagcttgattttgtttgaggtgttcctttccccagctcctgtagtaagttctgagtggtccaaactggtcttggcagtcccagtccccttagctgtggctgctgtaagcatcagcatgtgatgcaaatcttttatcttcttcaactccgaagaaattgtgttaatatttttaattactttgtccacatttagcttatgatcagtaacaggcttcttacccatctttaagtcaatccttgcctctaccttttcctgagcagggagaatttctgcaatttctctcatttcagagccactgtaaaaaaactggccaaccgtcaccgaggttctgacaggagcagggagccgacggtgaaggcgaagccgcgccccct

SEQ ID NO: 735992 - DNA, 585 bp, Homo sapiens
acattttttgcttgtttacattatttttattttgttttaaattatatatatacaaattagtaaactcaactctcccaaatatttgttagttcaacaataaaacagaaactcataacaaataagaaatcagatagaaaaactgttagaaacaagggatacatctgatattttagactcttcaaagagggggttgtttctttctgcttctgctaagttctcagtcttgatgggatgattaaaatgtaggataaggtcacaaagcaataactgggagagcttatttggtgcctaacgaacggccatgccctcttcttcttggagtcacagcttgattttgtttgaggtgttcctttccccagctcctgtagtaagttctgagtggtccaaatttgtccacatttagcttatgatcagtaacaggcttcttacccatctttaagtcaatccttgcctctaccttttcctgagcagggagaatttctgcaatttctctcatttcagagccactgtaaaaaaactggccaaccgtcaccgaggttctgacaggagcagggagccgacggtgaaggcgaagccgcgccccct

SEQ ID NO: 735993 - DNA, 524 bp, Homo sapiens
acattttttgcttgtttacattatttttattttgttttaaattatatatatacaaattagtaaactcaactctcccaaatatttgttagttcaacaataaaacagaaactcataacaaataagaaatcagatagaaaaactgttagaaacaagggatacatctgatattttagactcttcaaagagggggttgtttctttctgcttctgctaagttctcagtcttgatgggatgattaaaatgtaggataaggtcacaaagcaataactgggagagctcttttatcttcttcaactccgaagaaattgtgttaatatttttaattactttgtccacatttagcttatgatcagtaacaggcttcttacccatctttaagtcaatccttgcctctaccttttcctgagcagggagaatttctgcaatttctctcatttcagagccactgtaaaaaaactggccaaccgtcaccgaggttctgacaggagcagggagccgacggtgaaggcgaagccgcgccccct

SEQ ID NO: 735994 - DNA, 373 bp, Homo sapiens
acattttttgcttgtttacattatttttattttgttttaaattatatatatacaaattagtaaactcaactctcccaaatatttgttagttcaacaataaaacagaaactcataacaaataagaaatcagatagaaaaactgttagaaacaagggatacatctgatattttagactcttcaaagagggggttgtttctttctgcttctgctaagttctcagtcttgatgggatgattaaaatgtaggataaggtcacaaagcaataactgggagagctctcataggattatgatgaagagagttcatttatgcagagctcttagaagagtcctggattatggtaaattctgtaaaggttggctgctgacatta

SEQ ID NO: 735995 - DNA, 1055 bp, Homo sapiens
tagttattacattttattttatgaaagaatattctccaaactagaacaattagataatcaagtttggggggaatctaaagcttcttaactgttttaaatgagttcaagcatccagaaccatttattcatttaataaaaattttttaagaatcgaatcaatcaaggcaccgtgttaagtactagaaatacccataaggagcttacagttgagcagggataagaaaagtaaggaaatatgcaattataaaatagtataacaggtgatagcaaaaggcagaaaggataacatgctggctcaaaaaaagttttccattgtaagagaccttgactactagcagttaacctggtgtgttggaggtagggtatagcaatgggatttcagacagacaagtatgtgttgaaacagatacagaaaagcacttgtggagatatgcaaatagttcagtacagctggagcatagaacatgcagtaagaacagagtaagagactagaggggaaaggaggggaatgatctgagcaggtcatatagtccattctaagatgtttagactttatcctgaggacaatggtgagccaatgagggttttctgcagattcgcattttagaaggagaatcttcactgtggtgttgaagtatttggtgcctaacgaacggccatgccctcttcttcttggagtcacagcttgattttgtttgaggtgttcctttccccagctcctgtagtaagttctgagtggtccaaactggtcttggcagtcccagtccccttagctgtggctgctgtaagcatcagcatgtgatgcaaatcttttatcttcttcaactccgaagaaattgtgttaatatttttaattactttgtccacatttagcttatgatcagtaacaggcttcttacccatctttaagtcaatccttgcctctaccttttcctgagcagggagaatttctgcaatttctctcatttcagagccactgtaaaaaaactggccaaccgtcaccgaggttctgacaggagcagggagccgacggtgaaggcgaagccgcgccccct

SEQ ID NO: 735996 - DNA, 1114 bp, Homo sapiens
agtcagatttcttaatatgtactgtaaatttgtaaaatatgtagcataaagcactttccaaacttatttggccataagaacattgactctgttctactgtacaccatctattaacattgcttgaaacagcagggttcacagatcaaagtccaggaaatgctgtcctagggagaacacatggaaaaagcatattaggcactcactatttggtgcctaacgaacggccatgccctcttcttcttggagtcacagcttgattttgtttgaggtgttcctttccccagctcctgtagtaagttctgagtggtccaaactggtcttggcagtcccagtccccttagctgtggctgctgtaagcatcagcatgtgatgcaaatctggccaatgaaagggaactgtgctggagggatctgggaggagacttataaaaagagactgtctatatatgagcacctctgaaggtaatgatcatgaggggtaataaagagagtgaacatgacagagcagaaagatggaaagagcctggtccctgacaaaatctttaaacctctgaattaactttagggctctgctaccttggatcttcttgtttttccttattgtataagttaagttggtttttttgttacttatagatgtaggcctcataactgacacaggttatctttaaatacccaagagttgttttaaaaagaataactacatattcagtgtagttttcatggttagaaataggactcttaggtgaaagcaataggggaacagatttcagctagctggtgagaaggaattgtttaaaatagaatggattgactagtgagacaggaagttccccagcataagaaatgtttggtcagggatagattatccctagaaatattcaatcacagaaattttcttgggataaaataactgaatatgtctgtgaggtgagcgactaaacatcatgacctataaggtctaatcctactatatgaatctgtttaaaatgaagaagctttaagtcacagaatctaatttatactttttaatttggaatggaccttaggggcttagtaagaatttataaagacaatgaattttgctgaatgtgacatagtcttgaatggtgtgt

SEQ ID NO: 735997 - DNA, 739 bp, Homo sapiens
ggactggaggcaggacaggtctgggtcaagccctccccggggagctcggccaggccactacccagaaaggagaggctgctccaacagcaattcaccgggagtggggaagcggagaccagactgtaggggccataggaatggggggtcagaagccaggatgtcgctgactcaaggcctgataccactagagcgccatctccgggccacaggacgccgcccaggccctcagcccgcagccctgcagagccatcgttagcaccgcaggttctactctgaaagcccagcctcctccttggcccaactgacacctgggaggagccccagatctttagggccctcagcgacccaactgcccatgaagaccccccagatctttggggccatgagcggcccaaccacccgctcaacagctaaagatggagcctgaggcatctggaagtttccacagtcctcgccctcccagacaggatttggaatgaacctttggggcttactaagtttcttgccaagtggacaggattagggtaatgtaaaatgccctcagagtgaccccggcctacggacagccaccagccgccaggcccacccagccaaccgtccccttctcggcccaaccgacacccagggagaggctccgaggccagcccggcccaccgcccacccgttgggtggtggaaggtggagcctcgggcagcctggaaatttcagcggtcttcaccctcccaaaccagattccgct

SEQ ID NO: 735998 - DNA, 2733 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaaggagactctctttcaaagttccaacatcgtaccagttctatcttcctcttaacacagacgtgccatccatgttgatgtgaaaggaccaatattaaagagatggcagcaactttttgctttttgccctagacgtttctagctagtcctttaatatcataaagtcttaaacatatttcccgtagccagtgccgaaactttaccttagatttatttatcagaaatgggaaagcaaaaatctttcatctttcacacttaaactccacaccagtagttctcagtagtagttgcacatttagatcacccggagaacttttgaaaaatcccgattcctgggtctcaccttgagattctaattattctgggggtgctgtgtcagctctgggagtcttcaaacttcccaggtaattctaatttgaagccaagactgtgaatcactggtccagaagtatgtttgtttagcagagatgttctgacaggctcaattaacttgcaataaaaggaacaaaggaaagtcattattgccaactcatggctatttaaagctatcctgatttggtatgaggagaagggagtagtttaaaggagtccttaccaattaattctattttaatattagatctttacagtattaatattatgtagcaataatttattgaatggaaatttaaagtacaggacaatcaaaacagtagtttagcaaatatcagaaaaaagaaaagaaaagagaacatctgcattcaattttgctcaagggtctgatgaaggaaagactatctagagatcacagggttttaagaagggtgaatttcatggcatgtggatgttttctgactttggatgtggaaaagaaagtttagggaattaactcacaggaatactaggaagatatatcttgagttaacc

SEQ ID NO: 735999 - DNA, 2562 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaaggagactctctttcaaagttccaacatcgtaccagttctatcttcctcttaacacagacgtgccatccatgttgatgtgaaaggaccaatattaaagagatggcagcaactttttgctttttgccctagacgtttctagctagtcctttaatatcataaagtcttaaacatatttcccgtagccagtgccgaaactttaccttagatttatttatcagaaatgggaaagcaaaaatctttcatctttcacacttaaactccacaccagtagttctcagtagtagttgcacatttagatcacccggagaacttttgaaaaatcccgattcctgggtctcaccttgagattctaattattctgggggtgctgtgtcagctctgggagtcttcaaacttcccaggtaattctaatttgaagccaagactgtgaatcactggtccagaagtatgtttgtttagcagagatgttctgacaggctcaattaacttttatcttcttcaactccgaagaaattgtgttaatatttttaattactttgtccacatttagcttatgatcagtaacaggcttcttacccatctttaagtcaatccttgcctctaccttttcctgagcagggagaatttctgcaatttctctcatttcagagccactgtaaaaaaactggccaaccgtcaccgaggttctgacaggagcagggagccgacggtgaaggcgaagccgcgccccct

SEQ ID NO: 736000 - DNA, 1861 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggtaaggatttcaaatttcgacattttcccaaagtctttatttatgccactctgcatgccttcatggagcgatctttgagagtccgtgctgtatggcaaatttaggattaaatcacatgagtgaagcccttcatttattggaagagaaataaagcaaaatctttacaatggttact

SEQ ID NO: 736001 - DNA, 1480 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagggttaggtgaggttcgcgggtaggagac

SEQ ID NO: 736002 - DNA, 1171 bp, Homo sapiens
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccacatcctccattcgtggccctctggacaagtggcgggctctgcactcatgagggcttcatatgttgctgcccccctcttaatcatggcctcatgttcctgtaataccaacttaaatgttcgcgctcctattcaatgttccgtcaacgggccgagc

SEQ ID NO: 736003 - DNA, 1789 bp, Homo sapiens
gtggcagagtctagaacagggagctcagataggaggctactgcggtagttcagtgaagaaatggacatggatgtttgtaggcagaacatgaagatgaggaaaagtgagcagatccagacaggttttgggagtgccggctcttgctgatgtattggaagtgcttcctaacgtttggatctttatgcagccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaa

SEQ ID NO: 736004 - DNA, 1345 bp, Homo sapiens
ttttcttttcacttacatctgtaactgtaaaatttattcagtttctaaaaatttacattttcagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaaggagactctctttcaaagttccaacatcgtaccagttctatcttcctcttaacacagacgtgccatccatgttgatgtgaaaggaccaatattaaagagatggcagcaactttttgctttttgccctagacgtttctagctagtcctttaatatcataaagtcttaaacatatttcccgtagccagtgccgaaactttaccttagatttatttatcagaaatgggaaagcaaaaatctttcatctttcacacttaaactccacaccagtagttctcagtagtagttgcacatttagatcacccggagaacttttgaaaaatcccgattcctgggtctcaccttgagattctaattattctgggggtgctgtgtcagctctgggagtcttcaaacttcccaggtaattctaatttgaagccaagactgtgaatcactggtccagaagtatgtttgtttagcagagatgttctgacaggctcaattaacttgcaataaaaggaacaaaggaaagtcattattgccaactcatggctatttaaagctatcctgatttggtatgaggagaagggagtagtttaaaggagtccttaccaattaattctattttaatattagatctttacagtattaatattatgtagcaataatttattgaatggaaatttaaagtacaggacaatcaaaacagtagtttagcaaatatcagaaaaaagaaaagaaaagagaacatctgcattcaattttgctcaagggtctgatgaaggaaagactatctagagatcacagggttttaagaagggtgaatttcatggcatgtggatgttttctgactttggatgtggaaaagaaagtttagggaattaactcacaggaatactaggaagatatatcttgagttaacc

SEQ ID NO: 736005 - DNA, 1189 bp, Homo sapiens
acattttttgcttgtttacattatttttattttgttttaaattatatatatacaaattagtaaactcaactctcccaaatatttgttagttcaacaataaaacagaaactcataacaaataagaaatcagatagaaaaactgttagaaacaagggatacatctgatattttagactcttcaaagagggggttgtttctttctgcttctgctaagttctcagtcttgatgggatgattaaaatgtaggataaggtcacaaagcaataactgggagagcttatttggtgcctaacgaacggccatgccctcttcttcttggagtcacagcttgattttgtttgaggtgttcctttccccagctcctgtagtaagttctgagtggtccaaactggtcttggcagtcccagtccccttagctgtggctgctgtaagcatcagcatgtgatgcaaatctggccaatgaaagggaactgtgctggagggatctgggaggagacttataaaaagagactgtctatatatgagcacctctgaaggtaatgatcatgaggggtaataaagagagtgaacatgacagagcagaaagatggaaagagcctggtccctgacaaaatctttaaacctctgaattaactttagggctctgctaccttggatcttcttgtttttccttattgtataagttaagttggtttttttgttacttatagatgtaggcctcataactgacacaggttatctttaaatacccaagagttgttttaaaaagaataactacatattcagtgtagttttcatggttagaaataggactcttaggtgaaagcaataggggaacagatttcagctagctggtgagaaggaattgtttaaaatagaatggattgactagtgagacaggaagttccccagcataagaaatgtttggtcagggatagattatccctagaaatattcaatcacagaaattttcttgggataaaataactgaatatgtctgtgaggtgagcgactaaacatcatgacctataaggtctaatcctactatatgaatctgtttaaaatgaagaagctttaagtcacagaatctaatttatactttttaatttggaatggaccttaggggcttagtaagaatttataaagacaatgaattttgctgaatgtgacatagtcttgaatggtgtgt

SEQ ID NO: 736006 - DNA, 936 bp, Homo sapiens
caactgacagactaaacttcccttgcacttcatctattaccgacagatatagtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaa

SEQ ID NO: 736007 - DNA, 2401 bp, Homo sapiens
  misc_feature (24)..(24): n is a, c, g, or t
  misc_feature (51)..(51): n is a, c, g, or t
atgccttattaagggctgaacacnttaatttagaaacccaacgcttgtggnttgtaaaactaaagcgtgtacgtcgatcggaggatgaagcagacgctcgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaa

SEQ ID NO: 736008 - DNA, 1890 bp, Homo sapiens
agctcaggtacccccagacggcaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttaaaaaaaaa

SEQ ID NO: 736009 - DNA, 1399 bp, Homo sapiens
  misc_feature (1163)..(1163): n is a, c, g, or t
tcccaaatggttacgtatttcttttacaaaatatgctgatgtctttttttttttacaggttgaaaaaagaatagcttaggagtagcacatagagagttcttgtgtgtggcctttgtttctcttgacttttataaaataggatgtttcttgaaagctgggtgctgttaaataatgcatggttttcaactggttagatggtacagcagaacactgggggtgaagaaacaaggatttcagtactaattcagccaacaactatccctgtaatagtgagcaagtaatctgtataatcctgcatttgctattctatttcatacaaataaagctataagttagaacttacacttgtagtgtttatgacactccaaaaatagcttgtggtgttcatgacaatttaggatttaacacaatgttcaaatttgataaaaatatgagaaagctatacgatacaaacatgcttaaaagctatttgccatttttaattttaacatatttaaaaaataaaatttaaagacatctggatttcttaagaacatagtggcggtttagttctcaagctttccttgatgttgctttgtgtggttttccaggaataatggtaatcaagcaaaaagatttaaacacacacacacacacacacacacacacacacacagtctctctctctcagcaaaaccaagagctagagtaaacctataactcccaatgccttgtaagtttagccagaaacaactaaaatactcagaacttttgttgaagcccacaacagtataatagggagacctgggaaagcaaagggagcctagcagttgtatgtcacagtgagaagtgtcagggacagggcacaaattgcacccagggcagccactagaagaatcagtgaattaacatgtgtaaagtacccagaaatatccagaggtgatatgtgtcagaaagcattattttgtaaaagtgaaggaaacacagtgggaatgatggctccttttgcaatggccagtaagaaacctggggagctcaaagcttgagatcagccctgtaagccagatgagagtcatagaattagagaaggtatggcttcaccggaagtgccatattttgaaggagccattcaattcagtagcaacagaggaaggagttcttgagcgagaacatccaccttctanatttatagaaatcctctgtgaagttatctggtccagggaaattcaactcaattacatatgaaaaactaaaaagcaataaataacaaagctttagagagacattctaaagaaaaacaataaaaaaaaaataacaataaaacccataaagctatagaccaaagtctcatagatttagatgcaaaatcctaaaatcgaaaaaaaacatctagccatatccataaactatatcatcacca

SEQ ID NO: 736010 - DNA, 581 bp, Homo sapiens
  misc_feature (3)..(3): n is a, c, g, or t
  misc_feature (511)..(511): n is a, c, g, or t
  misc_feature (513)..(515): n is a, c, g, or t
  misc_feature (537)..(537): n is a, c, g, or t
  misc_feature (539)..(539): n is a, c, g, or t
  misc_feature (545)..(546): n is a, c, g, or t
  misc_feature (552)..(552): n is a, c, g, or t
  misc_feature (565)..(565): n is a, c, g, or t
  misc_feature (574)..(574): n is a, c, g, or t
ggncattgtgccctgccaaggcacagcgtagatctggaaagagcagaatgctttccttttcagatgtggctggtcatggaaggggcagttgtccaagttgggctgggtcttggtacacaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaaaaaaaaaaaaaaaaaaaaaaaaaaaaaaaaaaaaaaaaaaaaaaaaaaacaaaacaaaaaaaaaaaaaaaaaaaaaaaaaaaaaaaaaggggggggcncnnnaaaaattcccccggggggcccnantttacnncacccntttttttgaaaanggggccccnaaagggg

SEQ ID NO: 736011 - DNA, 955 bp, Homo sapiens
  misc_feature (631)..(631): n is a, c, g, or t
gttcccgactagccgacagcaaggggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaacaccacnaccacaccccccaccccacccaccaccacggcgggcccccccacaacaacacccccccgaggcgcccccgcccacgccccccgccccgccccccaaggcgcccacaagcgacgcgccaacaacacaccccggccccgctgtacacaccccgacaacggtgccaccgcctcccgcgacccccgggcacagaaccccccctccgggagccaccacacgggccacccctccccgcctcacaccccagcgcaaccacacaccgcggactaccgcgcccacacccgccaaccgcccccgcacacccgcacgagccccccgcactccacg

SEQ ID NO: 736012 - DNA, 739 bp, Homo sapiens
gcacgagctcgtgccgaatcggcacgagctcaccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgctgactctgagaagaccgaggacgagggggcttgtgtcgggcgctgcttcctcttcttctggtctatagccgtt

SEQ ID NO: 736013 - DNA, 938 bp, Homo sapiens
  misc_feature (868)..(868): n is a, c, g, or t
  misc_feature (870)..(872): n is a, c, g, or t
  misc_feature (894)..(894): n is a, c, g, or t
  misc_feature (896)..(896): n is a, c, g, or t
  misc_feature (902)..(903): n is a, c, g, or t
  misc_feature (909)..(909): n is a, c, g, or t
  misc_feature (922)..(922): n is a, c, g, or t
  misc_feature (931)..(931): n is a, c, g, or t
tggccccggggataatttttatgtgggatttcgtcgaccacgcgtcgctagcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaaaaaaaaaaaaaaaaaggggggggcncnnnaaaaattcccccggggggcccnantttacnncacccntttttttgaaaanggggccccnaaagggg

SEQ ID NO: 736014 - DNA, 968 bp, Homo sapiens
gaatatccgggatcgcctcggtatcgcagcgggtcctctctatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaacaaaaaaaacaaaaaacaaaaaacagggcgggcacaaaatacccgaggcaacacacaggcccacatttgaaaaaaggcccaaaggtgtaaaacgcaacgggcgggtaacacgcgaggagaagcggaactggacaccactgg

SEQ ID NO: 736015 - DNA, 950 bp, Homo sapiens
  misc_feature (880)..(880): n is a, c, g, or t
  misc_feature (882)..(884): n is a, c, g, or t
  misc_feature (906)..(906): n is a, c, g, or t
  misc_feature (908)..(908): n is a, c, g, or t
  misc_feature (914)..(915): n is a, c, g, or t
  misc_feature (921)..(921): n is a, c, g, or t
  misc_feature (934)..(934): n is a, c, g, or t
  misc_feature (943)..(943): n is a, c, g, or t
aacataggctagtacgggcctggtttaattggccgaggagcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaacaaaacaaaaaaaaaaaaaaaaaaaaaaaaaaaaaaaaaggggggggcncnnnaaaaattcccccggggggcccnantttacnncacccntttttttgaaaanggggccccnaaagggg

SEQ ID NO: 736016 - DNA, 920 bp, Homo sapiens
ccccctttacccttccccctcctatcttccccccctactcgctggcccggtccggaattttccacagcagcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtacaccctgatgaaaagactgaggaaaatgctgcctttcctgaatggctaccaggcagggaatgatgctgggaagtgtttaccccacaggctctgtgccttctctgactgggcagctcatgctgtatgcatggaggcatcattaccaaacacacctctgaggccagcggccagcgtctgactcacaagccatgactgccccaccttcttacaacaacaatagcagtttccccgtgaggattcacccctcctcccctctcactccgcctttttccagggaagctgactctaccctttggaccacagcttggagcacttgaccc

SEQ ID NO: 736017 - DNA, 1010 bp, Homo sapiens
  misc_feature (814)..(814): n is a, c, g, or t
  misc_feature (819)..(819): n is a, c, g, or t
  misc_feature (822)..(822): n is a, c, g, or t
tcaggctggtacggtcccaaggtcttatgatccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcanaacanacnaaaacctccagggcctatatgggcgcgcacaggatgaacggactcgcaaagttgtcctggccgctcttgaaaggaaactgcggccagaggaaatatcgaacagacgataatcacgacgagaaataaaggagacaaagaatgaaaaccagcacccgacccattgcgaagaaaccagagagagagcgacc

SEQ ID NO: 736018 - DNA, 895 bp, Homo sapiens
agggccgaggacgcccgccccacccccacaccgcccctaaaaccttagacggcaagagtccggattctccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaattctccggcggtcggcaaaggcggactccaaggggg

SEQ ID NO: 736019 - DNA, 933 bp, Homo sapiens
  misc_feature (827)..(827): n is a, c, g, or t
gcacgagctcgtgccgaatcggcacgagctcaccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcgcaaaaaaaaaaantctcagagcgaatacggcatagggctgaccttcaagggggcccgaaccagtttgtaccttagaaggtaattcagctttggggtaacctggctaaagttccgtgtaa

SEQ ID NO: 736020 - DNA, 916 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736021 - DNA, 855 bp, Homo sapiens
aacataggctagtacgggcctggtttaattggccgaggagcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736022 - DNA, 848 bp, Homo sapiens
gcacgagctcgtgccgaatcggcacgagctcaccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736023 - DNA, 1152 bp, Homo sapiens
  misc_feature (828)..(828): n is a, c, g, or t
gcacgagctcgtgccgaatcggcacgagctcaccggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaacaccacnaccacaccccccaccccacccaccaccacggcgggcccccccacaacaacacccccccgaggcgcccccgcccacgccccccgccccgccccccaaggcgcccacaagcgacgcgccaacaacacaccccggccccgctgtacacaccccgacaacggtgccaccgcctcccgcgacccccgggcacagaaccccccctccgggagccaccacacgggccacccctccccgcctcacaccccagcgcaaccacacaccgcggactaccgcgcccacacccgccaaccgcccccgcacacccgcacgagccccccgcactccacg

SEQ ID NO: 736024 - DNA, 762 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaagggtatgtgccttatatgggtccagggccagtcatacactgcagaggggtgtgtgtgtgtgtgtgtgtgtgtgatgcacatgttctgcagggtacgtgtgcatgtgcctgagtgtgtgtacacgtggagatgcatatgtgtttccaagtataggtttgtgtggggaagtgcacgtgagtgtgtgcaagtgggtgtgtggatgtgttggggaagtgtgggggtttat

SEQ ID NO: 736025 - DNA, 948 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctgagttcttggctgtctggggatgtgcacacaggcagggtttccgcagttcctttatgaag

SEQ ID NO: 736026 - DNA, 1026 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaacaaaaaaaacaaaaaacaaaaaacagggcgggcacaaaatacccgaggcaacacacaggcccacatttgaaaaaaggcccaaaggtgtaaaacgcaacgggcgggtaacacgcgaggagaagcggaactggacaccactgg

SEQ ID NO: 736027 - DNA, 1061 bp, Homo sapiens
  misc_feature (991)..(991): n is a, c, g, or t
  misc_feature (993)..(995): n is a, c, g, or t
  misc_feature (1017)..(1017): n is a, c, g, or t
  misc_feature (1019)..(1019): n is a, c, g, or t
  misc_feature (1025)..(1026): n is a, c, g, or t
  misc_feature (1032)..(1032): n is a, c, g, or t
  misc_feature (1045)..(1045): n is a, c, g, or t
  misc_feature (1054)..(1054): n is a, c, g, or t
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaaaaaaaaaaaaaaaaaaaaaaaaaaaaaaaaaaaaaaaaaaaaaaaaaaacaaaacaaaaaaaaaaaaaaaaaaaaaaaaaaaaaaaaaggggggggcncnnnaaaaattcccccggggggcccnantttacnncacccntttttttgaaaanggggccccnaaagggg

SEQ ID NO: 736028 - DNA, 1040 bp, Homo sapiens
  misc_feature (970)..(970): n is a, c, g, or t
  misc_feature (972)..(974): n is a, c, g, or t
  misc_feature (996)..(996): n is a, c, g, or t
  misc_feature (998)..(998): n is a, c, g, or t
  misc_feature (1004)..(1005): n is a, c, g, or t
  misc_feature (1011)..(1011): n is a, c, g, or t
  misc_feature (1024)..(1024): n is a, c, g, or t
  misc_feature (1033)..(1033): n is a, c, g, or t
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaaaaaaaaaaaaaaaaaaaaaaaaaaaaaacaaaacaaaaaaaaaaaaaaaaaaaaaaaaaaaaaaaaaggggggggcncnnnaaaaattcccccggggggcccnantttacnncacccntttttttgaaaanggggccccnaaagggg

SEQ ID NO: 736029 - DNA, 869 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaagggagcttttggccctacattaactttctttttgggtttcaaaaaaaccccccggaggggctggaggcattaaacccctaaa

SEQ ID NO: 736030 - DNA, 863 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccacgtccccgcatcaacgccactaagcactccgctggcccttgttcccagcaaggggtctgcacctccttctccttctggctccacagccccctgtcggggcctccacccccttctcgatcacaaattcctcgcct

SEQ ID NO: 736031 - DNA, 458 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggaggtcaaaatgtaattaaccatctccccgagcgtttgctccattttccctcagtgggaggcgatccatggttcgcgcactggcttgtgggccaacacccccaaagcaaactgagggccttgtggtgaaaccgcatccc

SEQ ID NO: 736032 - DNA, 742 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736033 - DNA, 838 bp, Homo sapiens
ggaaaagggagtgcaggccgcggtggggtggggcggcgaaggccggaagggataaaaccgcagtcgccggcctcgcggggctcacggcctcgcctcggtatcggtacgcagcgggtcctctctatctagctccagcctctcgcctgcgccccactccccgcgtcccgcccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736034 - DNA, 732 bp, Homo sapiens
ggaaaagggagtgcaggccgcggtggggtggggcggcgaaggccggaagggataaaaccgcaccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaatcgaccacgcgtccggtcctagatcgc

SEQ ID NO: 736035 - DNA, 280 bp, Homo sapiens
gggtccggaattcccgggatcactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagtt

SEQ ID NO: 736036 - DNA, 1900 bp, Homo sapiens
aacctacggctaggtacgaggcctgggtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagtt

SEQ ID NO: 736037 - DNA, 2632 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcgtgaggaggtcacgcctcgggtcgtgtacgcttgcgtggccgagccctttgatgcgccacgctgcgcctgctgcgcacgagaatacggtcgtattcgacacgcagctcagcgctatcgcatgcgcggtcagcaaacctagtggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagtt

SEQ ID NO: 736038 - DNA, 2586 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtattttcccctattttgctatatttcttgtagattgaatatttattgggcttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagtaattgagtt

SEQ ID NO: 736039 - DNA, 917 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagtcgcaggctcgactcggcattcccagatctcctcccaccgttcctttccttccctgggcttccacaagccccgcccaccggcctgcgctgctgatagattggcgaactgggtagatgctctttgcagggctgtgacccaaaccgaagggtttgcccttttgcctcgtgcatggattgatgccataaatgagaagttaaccaaactatgtcttcattgttttaattagtgacgctgcagccagaagagcaaaactttgcaaaacaacctagttctattactgaacactgttgtgtggcctcttaaggttaaggcccgagagtcacatttagagtcctaccccgtcttcatagtcccccaatacatatttaatgactaaagtaataaatgaatattgggcaggaaaggcaagaaatatgcctaacactagcaagaagagacttaaggggaaaatggtaaacactcttagcacttcatgtacatcttgcctctgaaataagattcaagagctgattcaactgatttttactagtagaagcaataagtataagtagatgagaaggaaataatagatgtaaaaggcatggaatatgcatacaaaataatattactgcttaattatgacaaataaatatatttgaatcct

SEQ ID NO: 736040 - DNA, 1018 bp, Homo sapiens
gaggagagccacgtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactaggtacctccgccccgccccccgagccccttgaggaggaagtaaagggggtatattccccagtcggcagtggcttgggtttcccgtctctgtgtcacttctagtcgcaggctcgactcggcattcccagatctcctcccaccgttcctttccttccctgggcttccacaagccccgcccaccggcctgcgctgctgatagattggcgaactgggtagatgctctttgcagggctgtgacccaaaccgaagggtttgcccttttgcctcgtgcatggattgatgccataaatgagaagttaaccaaactatgtcttcattgttttaattagtgacgctgcagccagaagagcaaaactttgcaaaacaacctagttctattactgaacactgttgtgtggcctcttaaggttaaggcccgagagtcacatttagagtcctaccccgtcttcatagtcccccaatacatatttaatgactaaagtaataaatgaatattgggcaggaaaggcaagaaatatgcctaacactagcaagaagagacttaaggggaaaatggtaaacactcttagcacttcatgtacatcttgcctctgaaataagattcaagagctgattcaactgatttttactagtagaagcaataagtataagtagatgagaaggaaataatagatgtaaaaggcatggaatatgcatacaaaataatattactgcttaattatgacaaataaatatatttgaatcct

SEQ ID NO: 736041 - DNA, 1763 bp, Homo sapiens
gaggcctccactctgaagcgggattccacgctcctgcaccctaagatcagctagactctctgccttgtttcatcttctttcttttcctaaagaatcacggggagaactgacctctctgggactcaaccgtggctggaaggggacaggagaagccctttctggaggacagctgagccctgcagctgccatcctgcctggcaggctagggctgggctgcgggaaggccccccaggagggaggtccggccactgcaccccgaggaaagggctgctttcggcactctgcgtggaggtcctggcttctgccgtccctggaggctccgttcccgtttcgccagctattttgctgcctcggccatctgttccctccctgtcatctcctctctgctttaaccttaaccactacttcactgcagatggtaccaggcagttctgctctcgacatccttcacgacgcctggccctccttctcatctccagcaagtgaaccgctctgtcctttttaaagcctcatcccaaagacacggccagagcttggagttggattcgccccacacaactccccctctttgatgccatctgctttcaactccaccactggccaggggcaaacacctaccccttcccctgccttttcctcctgagacttcttctcaaactcggccaagaagctctcctggcatggacagcgtgtctgctccgggtctctacctggtctccatcaacagagccatgtaaccgcccagagggctccaggtccgcaagctgaggcggaggccagaaactctgaagttcactcctactgtggaggaacgagggctcgtgctgggagtttgggtcatgaacagtttccctgtagaaaatggacctgaacactctgcagtaaggaattgtttcccgtgctggcatggtgggaaccgaaccaaaacacattttctatgttgtctgagctcacagggaacatccctctgctgtccttgctgttattctggcatgctggtgagaaaatgcatgcatgggctttacttagcaactcgctctgcctctcctctctgtcagggcgctcccctaaaatctctcctcttgacgtcttttttctggcataaggacccggagctttgaggagcgcagcagcccagaagctcctaaggagagaagctgttttggtgagattggttccaccaggctacatgccttgactgggacagaaatgggctgggaaggccgaaatttgacttctgcacctggatttgggctaaaaagtctcacagctcagcctccttgataagggttcttctatctcccctctatacttcctctgcagcagaaaagagtatcttggccgtgcagggaacgctcttctctcactctcgccactggggttaagggcagctacattactatagctccaagtcttggttgcccccagagagaggcagagatgtagcctgcccacatctggacacttgaagactctccaaacacctagaggagctgtggattcaagtgaagcaaccatctgatgccaccacggtccctccttccctttgccttcccttcttcccacaaaagagaagcccaaatccgccaccagaccagcccatctgcccgtggaaaccaagggaaccaaatgcatcgtactgggttgcaggccttaatctactctcgctgaattattcagggatggcattaacttataaatgagtgtgtttgactgattttgtggttgatgtacagataaagtctaatgaaagacagttataa

SEQ ID NO: 736042 - DNA, 1709 bp, Homo sapiens
gaggcctccactctgaagcgggattccacgctcctgcaccctaagatcagctagactctctgccttgtttcatcttctttcttttcctaaagaatcacggggagaactgacctctctgggactcaaccgtggctggaaggggacaggagaagccctttctggaggacagctgagccctgcagctgccatcctgcctggcaggctagggctgggctgcgggaaggccccccaggagggaggtccggccactgcaccccgaggaaagggctgctttcggcactctgcgtggaggtcctggcttctgccgtccctggaggctccgttcccgtttcgccagctattttgctgcctcggccatctgttccctccctgtcatctcctctctgacatccttcacgacgcctggccctccttctcatctccagcaagtgaaccgctctgtcctttttaaagcctcatcccaaagacacggccagagcttggagttggattcgccccacacaactccccctctttgatgccatctgctttcaactccaccactggccaggggcaaacacctaccccttcccctgccttttcctcctgagacttcttctcaaactcggccaagaagctctcctggcatggacagcgtgtctgctccgggtctctacctggtctccatcaacagagccatgtaaccgcccagagggctccaggtccgcaagctgaggcggaggccagaaactctgaagttcactcctactgtggaggaacgagggctcgtgctgggagtttgggtcatgaacagtttccctgtagaaaatggacctgaacactctgcagtaaggaattgtttcccgtgctggcatggtgggaaccgaaccaaaacacattttctatgttgtctgagctcacagggaacatccctctgctgtccttgctgttattctggcatgctggtgagaaaatgcatgcatgggctttacttagcaactcgctctgcctctcctctctgtcagggcgctcccctaaaatctctcctcttgacgtcttttttctggcataaggacccggagctttgaggagcgcagcagcccagaagctcctaaggagagaagctgttttggtgagattggttccaccaggctacatgccttgactgggacagaaatgggctgggaaggccgaaatttgacttctgcacctggatttgggctaaaaagtctcacagctcagcctccttgataagggttcttctatctcccctctatacttcctctgcagcagaaaagagtatcttggccgtgcagggaacgctcttctctcactctcgccactggggttaagggcagctacattactatagctccaagtcttggttgcccccagagagaggcagagatgtagcctgcccacatctggacacttgaagactctccaaacacctagaggagctgtggattcaagtgaagcaaccatctgatgccaccacggtccctccttccctttgccttcccttcttcccacaaaagagaagcccaaatccgccaccagaccagcccatctgcccgtggaaaccaagggaaccaaatgcatcgtactgggttgcaggccttaatctactctcgctgaattattcagggatggcattaacttataaatgagtgtgtttgactgattttgtggttgatgtacagataaagtctaatgaaagacagttataa

SEQ ID NO: 736043 - DNA, 1270 bp, Homo sapiens
caactccaaaacccccttctacacataacaccatgctctcctaatggtaggaggagacaaaaatggcagccgcagttcagttttcagttggtggaatgatttttgtgcacctggtgaaatcactttcacccttaggtattaaaatctccaaacttcatacatgcaattaaaaattattttttatttttaaaaaatctttttccacatgttctatgcaatttttcatacaactcttccttaagaaactcctagaggatgtacgcaattaaaatgaagtcaactcagaaaaacacggctccaggaaagtggtgggttcaatgtaggaaaaaagtgaaggcaatatccaggtgaagagagatgaagagagagtccagaatgacaggagaacagcagccccagaaagcagtcagctcttactggagcaggagagaggactctgctaaatacatctccgcaaagatcaaattgatggaatacctgatgtgtttgaatgcactgagagacttacgcttatggcaaagtttaggggtgtgttaggaataggactattaagccaagcaaacaaaaaataatataaatattaactccgagaggaagaagttgtacaaaaaaagaaatataattcaagtatgtactatatctttgactattcataatactgtacacatcgaatatagattgaatcaaagcagaggatggttgaagctcaatttgggggatgggggaaaggggaagggaaaaaaggtgaagattaaacccttcccttccatggctggaagttctgtgccccagaattcccttggttcctgcatgttctccaagctgatctacatctaagagctcatcacgtctggtttccaggtgggtttggccagtgggaaacccaggcaggagatcagagaggatgaggagaatggggtcaggacaactatttcctcccttgtggtgacataaggtaggctgttaacagagggaaactgtcagaagtatttgaaccagagcaactccatcttgaatgggggctgggtaaaataaggctgagacctactgggctccattcctaggaggctaggcattcttagtcaaaggatgagataagaggttggcacaagatacaggtcacaaagacaccactggccaagacccaccaacactaagatggtgataaaagggacctctgttcgtccccactgctcattatatgctcattataatgcattagcatgcgaaagggctgctattctctaataaacttgctttcactttaaaa

SEQ ID NO: 736044 - DNA, 2135 bp, Homo sapiens; identical to SEQ ID NO: 31422

SEQ ID NO: 736045 - DNA, 2090 bp, Homo sapiens
tccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaattgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaaaaaaaaa

SEQ ID NO: 736046 - DNA, 1256 bp, Homo sapiens; identical to SEQ ID NO: 34592

SEQ ID NO: 736047 - DNA, 931 bp, Homo sapiens
gtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaaggatgtgaagttggtcattggagcgaatggggaacttgtagcagaaataatcgcacatgtggatttaaatggggtctggaaaccagaacacggcaaattgttaaaaagccagtgaaagacacaataccgtgtccaaccattgctgaatccaggagatgcaagatgacaatgaggcattgtccaggagggaagagaacaccaaaggcgaaggagaagaggaacaagaaaaagaaaaggaagctgatagaa

SEQ ID NO: 736048 - DNA, 657 bp, Homo sapiens; identical to SEQ ID NO: 34591

SEQ ID NO: 736049 - DNA, 3011 bp, Homo sapiens
  misc_feature (1233)..(1233): n is a, c, g, or t
ttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaaccagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggangattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaccctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactaggctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctgagttcttga

SEQ ID NO: 736050 - DNA, 555 bp, Homo sapiens; identical to SEQ ID NO: 254355

SEQ ID NO: 736051 - DNA, 2280 bp, Homo sapiens
  misc_feature (502)..(502): n is a, c, g, or t
catacattatccccatccacatcatagccttaacttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaaccagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggangattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaccctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactaggctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctgagttcttga

SEQ ID NO: 736052 - DNA, 1306 bp, Homo sapiens
gagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaaaaatggct

SEQ ID NO: 736053 - DNA, 1779 bp, Homo sapiens
gagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggagcagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaaaaatggct

SEQ ID NO: 736054 - DNA, 1438 bp, Homo sapiens
aactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagtatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgg

SEQ ID NO: 736055 - DNA, 247 bp, Homo sapiens
gagctcggtacccctcggctctaccttgaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccagatatttgacaaacaggtagagcca

SEQ ID NO: 736056 - DNA, 8560 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctggctcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactggtattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaaaaa

SEQ ID NO: 736057 - DNA, 7704 bp, Homo sapiens
ggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctggctcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactggtattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaaaaa

SEQ ID NO: 736058 - DNA, 810 bp, Homo sapiens; identical to SEQ ID NO: 335078

SEQ ID NO: 736059 - DNA, 8135 bp, Homo sapiens
ggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccactgctacctgaaagacctcttgagagaactgactccaggccccagcctttagataaggtcagagacctcgctggctcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactggtattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaaaaa

SEQ ID NO: 736060 - DNA, 815 bp, Homo sapiens
ggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagtcatagtagcagatgtttaatgtctgtcggcagccgggcagtgaaagcgtattcatcgct

SEQ ID NO: 736061 - DNA, 1678 bp, Homo sapiens; identical to SEQ ID NO: 335090

SEQ ID NO: 736062 - DNA, 4684 bp, Homo sapiens; identical to SEQ ID NO: 335080

SEQ ID NO: 736063 - DNA, 4970 bp, Homo sapiens
ctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttcctattgctgctggtgcagctgtaaaaaagaaaaaaccaaaaattttgggatgacatgaaaggccataatgtcaggaaagagtagagaggactgaataatccagatggca

SEQ ID NO: 736064 - DNA, 1623 bp, Homo sapiens; identical to SEQ ID NO: 335084

SEQ ID NO: 736065 - DNA, 2664 bp, Homo sapiens; identical to SEQ ID NO: 454971

SEQ ID NO: 736066 - DNA, 397 bp, Homo sapiens; identical to SEQ ID NO: 62284

SEQ ID NO: 736067 - DNA, 477 bp, Homo sapiens; identical to SEQ ID NO: 62287

SEQ ID NO: 736068 - DNA, 1271 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtgggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggtatgcaccactgagcaggaccagcatggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 736069 - DNA, 1243 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtgggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 736070 - DNA, 1319 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 736071 - DNA, 1356 bp, Homo sapiens
gatgtttattttattaatctattttttaactgggtagggattgcttttgtaattagaaaaagtattaaaaactctctttaattaggaagattatgtaaagctgtaaagcaaatttattttgcatttcagaggctgtttctttatcttgctctctctcctgtggcagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaaggttt

SEQ ID NO: 736072 - DNA, 837 bp, Homo sapiens
ccaatcgcctcgtctggaaaaatgggaatggaggagagttgtacctacccagggtggttctgtgggcatttaaagagcaacttcatgtgagacgtggagtccatgtgtggcccatggtgggctccaggaaatgttggtgatgacagggatgagggagcaactgagagccggcagtgaggtgacacacccaaggtcacgccaccagcagaggtagctggtcacgctgctgagagccggcaggaaatagatgcggacaaagcagggtcggttttcagcttctctccacggaaaggccggctgaagtttccctcaccacgcagaaatcgataagcaggaggtttttaaaaaccacctccccattgaacctgccactgccggagctgaaggctgtgcgttttgtggtccgctctgccccagggccacttagggtgcgtccacgctgggtgtgccaggcatgcacgtgggctgcagacgcccaggaggcagagccgagcctgccaaggttatgcgtgcacctctcagctccctgcttaacactgcgttcccgggagagagatttctccctggctgcttcacatccagaggagaacatcagctctcagcagaacataaggccctcttcacctgccagctgggcaacagcagttactctcattggagaccctttcccttcgccacttcccaggctactccagactgaatgcattcagggagtcacctcccaggtcaaaacctgctgtgataccatcaccctgcagcacagaccacagtcccaagcctcccattcttgaccccctccccagcccattcctgctgtcaaacaaacaaaaccttgca

SEQ ID NO: 736073 - DNA, 325 bp, Homo sapiens
gaggagcccacctgtcctcccggaagagatggcccctttcacttgagattccaggagattgcccagggagaaggtgtggagggaggggttttgagaaggaatatgaagcctccagtggtaagcagtaccagcaagacgaccaagaagaggcagttgggttggtcagttaggaggtcttgtcatccatcttggggttggcagagcaatagagacagacatcacatcaccatgggaagagaagagaataagaggaagatgaagattatattccatcagaagactggaaaaaggagattatggtgggaaggtctttgctggtgggaag

SEQ ID NO: 736074 - DNA, 2545 bp, Homo sapiens
gtaaccccattacctactcatagaggaggaactggaagccagagagggagatgccttattgacacagagcacaagtggcaggagctggcttcagacctcagtccatccggtgtggcagtccctcttcccaggaccaggtggagctggagagaaggaggaagaggagtctgtgaggtccagatggagatgctcggcaggccctttccaaaggtgggaggtgaggtcggcctggaaccctactggatgcttaagtgtcctgccgcactgctgatgaaagcaggtccccaccgcagtgtatatacattgtgtgtttgcatctaaaacgtctatagttgtttgaaatgtttaaatctttaacccatctgagatgtgttttcatgtatggtgtgacacagagctctaatttgctctttttgcagatatccagtttgctaagcaccatttattgttccaacaccatcttttctctcaattccctgtctagactccggttctgttgatctatttgtctatttctgagccaatagtacatattaatgagcaaagcttaataaagtgtcttatggcttgataagataagcactccacccttcccccaaggcctttattccttttttttctttttgagacggagtcttgctctgccgcccaggctggggttcagtggtgcagtctccgctcactgcaacctccgcctcccaggttcaagtgattctcctgcctcagcctcctgagtagctgggactacaggcacgcgccaccatgcccggctaatttttgtattttttggtgcagatagggtttcaccatgttggccaggctagtctcaaactcctgacctcaagagatccacccatctcggcctcccaaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 736075 - DNA, 257 bp, Homo sapiens
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatatgtacttccccagctttcccgcttttatga

SEQ ID NO: 736076 - DNA, 1140 bp, Homo sapiens
  misc_feature (227)..(227): n is a, c, g, or t
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatntgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgcgtggaggacctctctaagctgaaaagcaaggaaatgacatcaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagtgtccaggtgccgtggctcacgcctataatcccagcactttgggaggccaaggcgggtggatcacctgaggccaggagttcgagactagcctggccaacatggcaaaaccccatctctactaaaaatacaaaaaattagctgggcatggtggcatgcacctgtaaccccagctactcgggtgactgaggcatacgaatcgcttaaacccgggaggcggagctgcagtgagccgagatcatgctgctgcactccagcctcagtggcagagcgagaccctgtctca

SEQ ID NO: 736077 - DNA, 2537 bp, Homo sapiens
  misc_feature (227)..(227): n is a, c, g, or t
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatntgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgcgtggaggacctctctaagctgaaaagcaaggaaatgacatcaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagtgtccaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 736078 - DNA, 2452 bp, Homo sapiens
  misc_feature (227)..(227): n is a, c, g, or t
tccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatntgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgcgtggaggacctctctaagctgaaaagcaaggaaatgacatcaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 736079 - DNA, 2826 bp, Homo sapiens
  misc_feature (516)..(516): n is a, c, g, or t
gaggagcccacctgtcctcccggaagagatggcccctttcacttgagattccaggagattgcccagggagaaggtgtggagggaggggttttgagaaggaatatgaagcctccagtggtaagcagtaccagcaagacgaccaagaagaggcagttgggttggtcagttaggaggtcttgtcatccatcttggggttggcagagcaatagagacagacatcacatcaccatgggaagagaagagaataagaggaagaagtggagatgagaggaacaggtcacctcttccaactatgaagggaaagaggtggatgagtggaagtgacccgtttggactggtctttttttatgtagctaatatttggcctgtgcttttctggatcaggccctgatgagcattttgtcaacaatatctccctgaaaccttaagagaacatcctagggttgacgtggttttgcccactatacagaagagcttcaaaagatgaaggcactttcccaagatggggggcagagntgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgcgtggaggacctctctaagctgaaaagcaaggaaatgacatcaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagtgtccaggtgctgggattataggcatgagccaccgtgcgcagccccttattcttttttaaaattgtcttggtcatattgcacatttactttttcaggtacattttataatcagcttgtcaaagttctgtgaacaaaatgtctgttggaagtttgagaagaattgcattgaaggggaaattaacatctttagaatataagttcttcccatctgtggacatggtgtctgtctctttttaatcagaattgtatttgttttgttttgttttgtttttaatgccttttaataaaggttggttgcttttgtcataaagatttttcacagttcttaataggtttattcctgaaaaccttattagttttgttgcttttgtgagtggaaaaactttcccttttttcattttgctttccaaattttaatcagtttactaatcactatgcttcattcacagacacacacacagcaaatgtgctttgtccctgggcacacaaatgaaaacacagcacacatgtaaatcagagctaattggctgaaaatgaattagaatttttgaattaaattttaattatacaagtaatacatgaatacattttcctttaaataaaattagagcattttaggtaaagaagtctctactggcctccccagcctgacctcaggccccttccccactttagaggcagctgctgttaggcatttgctgttgatccaaaatgttctcctatgcgcattgaaacatgtcctgtgttctattgttgcttttgtttgcttgcatagatgtggtggtgtacacactggaggtgctgctcctgagctcagggcaccttacgggactctcctcatgtcgcgtgtcacctgccgcagctggctccactgcccctttcagctggccgctggcaaccagaactgattgtgctatgatttatttagttgttgcttattgatcgactattaaaaggcttccagtcttgtttcaataagacaaacctgtaacagcatccttgtacatgccacttttgctcatgtacaagtgtttttctggagcagatacttagaaacagaattgatgggtcatagagtctacacatcttaaattctaatagtaactgctaaaatgttcttcaaagtacctttctgatttaatttcatgccagcagtatgtgtgtccatttctccagaccatctccaagttttacattttaaccaatctggtgggtgaaaaataatatcttgttttagtttgcatttttctgaattaccaggatggctgaagtctgtgtctcctatccatttatatttccttctctgcattacttgtccaaatcttttgcccatttcttttttttagggtacgttgtcttttccttattgattttttagaagttctttatgtattttgtatactttatgtgtattgcaaatattttctgtattgtgattcttgtcatttaattgtattgtgtctttggagaaatcttaaattttgatacagtcaaatcgatctattttaattttatgtctttttttcaattttatttaagaaagcctttcctgtactgaggtcataagcatttttcctgtatttcttctctaacatttatcatttacatatatgtgtgtgtgtgtgtgtgtgtatgccttttttaccacatgcaaaaaataaattccatatgcatacatga

SEQ ID NO: 736080 - DNA, 1754 bp, Homo sapiens
  misc_feature (694)..(694): n is a, c, g, or t
ctgcgagagggagggaggaaagggctgtgcaataaagtcctctcccattatcttactcaacacaatttattgagcaaatactacgtgttctaggccctgtacaggccatctcacttgatggccacaacagtcctgggaagcagacaaaccaagaatgctaatgcccatctgacatcagagacggcagtgctccccagacctctcacagcaagctggatggacaggcagggccagaagagtcctccagccaagcctcctccttggttcttgtacccaaaggtagagaaactgcaggtcttctgggtctgagcctggggcaggggttctggctggacgaaaaggggcagggaagcagcaggagccagagaccacaggctgagctggagcccacatggttcctaagggcagaacaggctctgaggaaagatgtgaacagctggaaggctgacagtgaggtctcagcagtgtggtgcacccctccccagcacatccgagtccctggggtcccaggtaccataggtactgcaagatttcccaagagacagcaccagcaacctgggcctgaccctgtacaaccgccaaaccatcacgagccccgcccaggcttgtgagaaggacatgcatggatcaagaccttgcccttgacccatctgcttctcagatgggctcccaatcaccagaggaagttgctgtnagcccactttccagactgcccccacactggggctctaagtttcaggtctgagattttatgctctgtgatcccccacttggggttcccagactccaagctcctggctcctgtgttcagtggctgaattcaacgtccgagattcggaatatgggctccagcctgcagaaactcttctccaggcattgtggtttgtgcctcctagtgttggctccctcatgaaaagagggtcaacacccttggcccccagccaagatctctgctcaatgtccatacaaggaggaagccaaaaccaagtgaggtgctggagccacattcaaatgtggttgataatcttggggcaggccagctctgatgtggatgaaagctgagccaactgtcgccacagctgcccagctgggtccgctgctcccctggctggctgttcagctgtctactaagcccaaaaaaaatactatgcctcactagcagaggctagacccagaaagagggaacaatgaggacccctcccctcccagaggaaagagctgagccactctccccatccagggaacagtaggtccaggctggatgctggtatgatgggaactgcccttttcacctgccagggagttcctaaagctgatcttcctggggttctgaaggttgcgacctaggttaatgagaccaaattctaggaaccactgcccaggccaaccaccgccagtgctgcagagatcaaagaaatccacagccacaggaaaaggagcttctttggacatgcccagctccaaactgtcccagggggaactggcacagcccttacatagcccaccccctcttggcctcaccgtggcctggaaattggccagagggtccacatcctgcccaaaccactctcctctcgtcccaaggcaaaggtgatgccctgaggcctagggctggataaagcccagctctggatgctgctaacccactctgctgccccaccccatcctccaatttttatactaggctctttgccattgtgacgtcccatgacatagtctgatgcacgataaaacaattatttctttatcttgca

SEQ ID NO: 736081 - DNA, 654 bp, Homo sapiens
tgttggccaggtgtggtagctcacccctataatctcagcactttaggaggccaagggccacagtgagaggattgcttgaggccagggattcaagaccagcctgggcagcatagtgagacccctgactctgcaaaaagttttaaaaattagctgggcatggtggcacacacctgtaattccagcttctttgaaagctgagttgggaggaccatttgagcccaggaggcctaggttatagtgagctatgaataaaactctccataaaatagattattgagtatactgtaccattataacttttacttggtaaataagccagtaatagtctactgaaaattaaattactttaaaaaataaaacaattatgttactatctgctataaagaaaataataattgtgttctttaaatttttccagaatgctttttaaggaaagccggagtgttcataatcatcttacttctgctccgtgagtaaatgcagactccagattgcttcatttattcacattatgtgctttagtgaacaaaagtatcatttattaaatgctagttggaataggacttaaaaagatcattttgaccattgactatttagacttcagaacacatttatctattgaaataattgtcagggtactctctaaacacctac

SEQ ID NO: 736082 - DNA, 398 bp, Homo sapiens; identical to SEQ ID NO: 302986

SEQ ID NO: 736083 - DNA, 630 bp, Homo sapiens; identical to SEQ ID NO: 302980

SEQ ID NO: 736084 - DNA, 635 bp, Homo sapiens
atgctttaaaattaaattatgtagatattggaaaattggtatttacatcatagaattatattttcttataaaaacttctctctacaaatgtgggctaataatttactgtttctgggagaaggttatatttctcggataggttaatattaatagctgttacctttcctaagatgtcatttttaacaaaatctatagaatttgtatacattgtctttgggaaagatatagtgtccttggataagtgtttcttgaagtgtggcccaaagacttacttacaccagaatcaccagaatgcttgtttaaaatgcaaattataaggttctaactcagataactgaatcgaaaccggaggtgagagtgctcttgaaccccaaggatctgcagttataacaaacgattgtaatgcacactgacatttgagaaaaaccactgctgatgctggattgctaacatcaaagagtaaagcattgttacttacataaatgatcattcttttatcattttgcaggtccccaaaataaaagaagatgatattgagatgaagaagcggaagcggaaagaggaaggggaaaaggagaagaagccaaggaaaaaagttcccaaacaactggggtacgttaaattaaacctaagaa

SEQ ID NO: 736085 - DNA, 648 bp, Homo sapiens; identical to SEQ ID NO: 302979

SEQ ID NO: 736086 - DNA, 396 bp, Homo sapiens
gcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcggaggtggaaagggcccagttaccggtaccggatccacctcgtgccg

SEQ ID NO: 736087 - DNA, 2117 bp, Homo sapiens
gcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggtaagtactgaaacaaaatatttaattagttatagttggtgaatgttgaaatacattcctaagatgaaaaagatgtatggtatttagcagaggtcagtaggcactataagatagatgttttcaacttcataataatcttagtacttttgtatttgggagaatagattcctgtgtagcagtggggaatatgcatacaccaattgtgaagcttaactttattaatacttggaaatgctaggtaaaatacaacaaatattctttcatagcataggtgagattgaaaaatatgtaagaaaaattcataagaccagaaacaaaaaaggagctgacagtgttaatctgtcgcttacactttggttgcccttggaggcatttggcactttctacccatcactttatggtttctttt

SEQ ID NO: 736088 - DNA, 2059 bp, Homo sapiens
gcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaaggaaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 736089 - DNA, 1904 bp, Homo sapiens
atcacacagaagtgtagttttgcttcccttaaaatcttctgtgctctgcctattcattcctccttccctcctaatcactggcacctactggtcttaactgtcttcagagttctaccttttccagaatgtcttatagagaaaatcatatatatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaaggaaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 736090 - DNA, 1083 bp, Homo sapiens
attcaagttagatatgacaccagattcttttgtctgctcgtagaagtctgcaacttcaatgctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaaggaaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaat

SEQ ID NO: 736091 - DNA, 497 bp, Homo sapiens
tagtaaagtgtgtttttcatttcagcaactgttaattctgttggtaccaagcctcccgacagcctattgagtacacagtcgatatttgttactgaatgaacatgggtgcatttggagttcagctccgtaataactggtgtttgccatcacaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagttttgtttggttttttttttttcaaa

SEQ ID NO: 736092 - DNA, 1767 bp, Homo sapiens
aagttatcacaagatctgatggttttgtaaggggcttctccctttgcttgactctcattcttctccttcctgccaccatgtgaagaaggacatgtttgcttccccttccaccacgactgcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagttaccgagagccctttcttttctcttttaatgggcggcacgtgtga

SEQ ID NO: 736093 - DNA, 1894 bp, Homo sapiens
aagttatcacaagatctgatggttttgtaaggggcttctccctttgcttgactctcattcttctccttcctgccaccatgtgaagaaggacatgtttgcttccccttccaccacgactgcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaagcaactgttaattctgttggtaccaagcctcccgacagcctattgagtacacagtcgatatttgttactgaatgaacatgggtgcatttggagttcagctccgtaataactggtgtttgccatcacaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagttaccgagagccctttcttttctcttttaatgggcggcacgtgtga

SEQ ID NO: 736094 - DNA, 956 bp, Homo sapiens
gaacattcagctgaagcagagcctggtgcattttgaaaccaggatgaggacccaggaggacctgacccagggtctgcttcttattgactttgaacagctgaagattgagaaccaaaccttcaatgagaaaattgaggaacgaaatgaggaacttttaaaacttcgcagcaaggtgaccaacagtgtgcaagtaataacccacgtgaaggaaaagctgcacttcatggacatggagaacgcgtgcaaaaagacacagctggcagaaatcgaggcccaggccgccctaggaagagacatcctgaccaagacgaagcaagcccgagaggggctgcggacggacaacatcagactgaatcagaagtgcggccttctaggcaaggactcacttcttcgggacttggaagaaaaggtggacaagaccgaactgcttcaccggcgcctggaatccctgaagcgccaccacgctagcctcactttgtcctgcagaggcgtgaggcagaagatcagggaggccaaagcctttctcccttcttgaccagatcgatgagaagagtctgcaaaacacttcatcctcaggacgtgctgtcctgctttattttaccttcgttgctattaaaaaggcctgtgtcatttgggacgggactctattttgtatttatctcaaaacgttttagcttccaaatcagtgctgagcccaaacctgggttaggagttttatctgggattgagcaaaaataggtccagaaaagcaaacaaagggtgatttaatgtaactgacttctcatgaaaaactgtcaaaagtctcaagtctgagcaattctataatttcagtgatgtaatactaaagagtactgttcctctttcatatgtaggagggtttaaaagttcagcgaatgggcaaggtacaaaaaaaccctgtgcattaagctaattattaaattctttggatttattaa

SEQ ID NO: 736095 - DNA, 907 bp, Homo sapiens; identical to SEQ ID NO: 384885

SEQ ID NO: 736096 - DNA, 663 bp, Homo sapiens; identical to SEQ ID NO: 77245

SEQ ID NO: 736097 - DNA, 451 bp, Homo sapiens; identical to SEQ ID NO: 77247

SEQ ID NO: 736098 - DNA, 1043 bp, Homo sapiens
tgctgggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgacaccattaaaggtgtctgatgagcagtcggattcgccttcaggatctgaatctaaaaatggtgaagcagacagttcagataaagaaatgaaacatgggcaaaaatctcccactggaaaacaaacaagtcagcacttaaaacgattaaaaaagtctggtttagggcacttgaaatggaccaaagctgaggacattgacatagaaaccccaggatctattcttgtcaacactaacttgagggcattaataaataaacatacgtttgcttccttacctcagcattttcaacaatacctcctgcttttgctcccagaagtggataggcagatgggaagtgatggaattttacgcctcagtacttcagctctaaataatgaattctttgcatatgcagcacaagggtggaaacagcgactggcagaaggtaaatttgtattttctattattatgtgacatattggagtacacataccgtactgagcttgtacct

SEQ ID NO: 736099 - DNA, 313 bp, Homo sapiens; identical to SEQ ID NO: 449285

SEQ ID NO: 736100 - DNA, 4082 bp, Homo sapiens
attgatgttcctttcctcacagcaacagataccacactacagtgggacaatttagacactcctgttaacctaacgtatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736101 - DNA, 792 bp, Homo sapiens
acaaggagttataatcttaggaaatgggtttcggagcaggaattttaacagtaatcagatccatgtaacttaaatgtgtgagtttcagtaattactgaaatgtagctagtgaacttgttggacattttggtttagaaataaatctcagaagttagattaaaatggcaagttttgtttctttttttagtgatctctttttatcttttaaaacaataggttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttccttaaaaaaaaaaaaaaaaaaaaaaaaaaggtgaaaactacgttgctcgaagtctggtgccactgtattgatacacattcccatcagctttcctacagactcagtaattaatttttacagggcttagaactatggtcatgcacaagactagatgaggggttgaagcaaacattccaacagcaaactgagatgggatgtttccttttctacttacaaagaaaataaatagaaatagattttacatgctttatttctttgagacaagccattgtaaattgttactagactaagtagtagtataccagtcattgactggtcttttcaactccactcaaatttgtaaaaagcaattcctcttatactatcatcttttttgtttt

SEQ ID NO: 736102 - DNA, 605 bp, Homo sapiens
ctactcttcttggtatccaaatattgccaataatttggaccttgggccttgggcctttgctcatcttttcaaagttgaggctttggactcactttaaaacacctggaaggctgggcttggtggctcacacctgtaatcccagcactttgggaagccgaggcaggtggatcgcttgagcccaggagttagagaccagccagggcaatatggccaagaccctgtctctacccaaaaatgtacaaaaattagccagatgtggtggcgtgcacctgtagtaccagctactcaggaggctgaggtgggaggattgcttgagccttggaggtggaggctgcagtgagccaaaatcacagcaccgcactctagtctggcaacataacaagactccatctattaaaaacaaacaaacaaacaaacaaacaaaaagaacttgggtctcctgcctgcattttaaagcgttttggtactcttcatttataaaattattacacctgtaattctcatttctcattattatttcctaaaatagtatggtccccattgctgagaggggtgcttctttttcacatctgccttttttcttactgtgattactgtaaccatag

SEQ ID NO: 736103 - DNA, 289 bp, Homo sapiens; identical to SEQ ID NO: 449284

SEQ ID NO: 736104 - DNA, 810 bp, Homo sapiens
ttagtagaggtccacggatctgggatgaacacaggcgcgcgtaatgccacaggtagggagacaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736105 - DNA, 3736 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatggttagttaaatgttaggcaactcactgccagtcttgctagtgtcatttgtgaaatagtcattttctgtctttgcaacatcattgaatgcattttcttctcttcttttctttaattttttaaaatttaataattttacaaattttatttttttacttttttatcctgtcctcaaaatctgttgctgtgaatgcattttcaatgtattatatatgctaatataagtgatcagagccaggatttagtattactcatggtggctaatgtatgaaatgacattccttatccgtatattaagaggcaacaggatagtcagtgcatctgagtactactttctttagaaatttgtgtctcctggccgggtgcagtggctcacacctgtaatcccaacactttgggaggctgaagcaggaggatcaccttagctcaggagttcaaggctagcctgggcaacatagtgagacctcgtctcttcta

SEQ ID NO: 736106 - DNA, 5008 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736107 - DNA, 4801 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtcccattggcacagcggggcctcccggtcagtcccaggctgcagctgtccaatgacaacaggaccctcactctactcagtgtcacaaggaatgatgtaggaccctatgagtgtggaatccagaacgaattaagtgttgaccacagcagacccagtcatcctgaatgtcctcatatgcccagacgaccccaccatttccccctcatacacctagcgtaccaggggtgaacctcagcctctcc

SEQ ID NO: 736108 - DNA, 4040 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgcgcatccactttcttcacctcccttgccagaatcctgggctcagagagctcatccccctggggtgtgag

SEQ ID NO: 736109 - DNA, 3940 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaactttcccgaggcaatttgacaattttctgtgattttatcgtcgacc

SEQ ID NO: 736110 - DNA, 3805 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcacttctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736111 - DNA, 741 bp, Homo sapiens; identical to SEQ ID NO: 449292

SEQ ID NO: 736112 - DNA, 1235 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacattgtaagtaatgacatttcattgttttctgtttgcctttttttatatatataattggctggtaatatgagaatatgcttataaaggagaaatttatttaaattctgtcccaggctggagtgcagtggcaccatcgtggcttacggcagtctcaacttcctgggctcaagcagtcctctcacctcatcctgcctcagcctcccgagtagctgggactacaggcgcccaccaccatgcctggctaatttttttgtatttttagtagagtcagggtttcaccatgttagccaggatggtctcgatttcctgacctcgtgatccacacgcctcggcctcccgaagtgctggaattataggcgtgagccaccatg

SEQ ID NO: 736113 - DNA, 2248 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgtgagttagattcctgtctatttacatttttcacaggattttcagctgcgtgagacttccagccaataataaaatgctatgactaccagccaataataaaatgctccaacttaaataaagattcgaagggaaaggaaatgagtgtttatatgatacttgctatggtctaggctttgtgattacacttccacatacatttctttccttgcaacaaccctaaaaaaagataatattgggtacgggggtacctgcatatgtcacatacatcacatctcatttatttctcgcaccacccttgtgaggaagataatattatacccattttacctgtggggaacctggtgctgaaagaaaaagtaacctgaatgtcatgatcagggtggaagatctgggatcaaaccgaaggactgactttaaagcttatattctctcaactacatcatttacattgtcctttattttaccttttccattaaaatggaatttttttcagaactagaaaattgaaaagagtaatgccaagaatcaagtatttgccttcttggagagccaactgatatatacactcattgccaaatgatcactaacgaaaattctaatcatttgattcctatttgcctgtatttcctctgtcactgcttattatcagaatattggtagttacatactttttacattatctatctcatcattctttctcatcctttttccat

SEQ ID NO: 736114 - DNA, 2621 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttccttaaaaaaaaaaaaaaaaaaaaaaaaaaggtgaaaactacgttgctcgaagtctggtgccactgtattgatacacattcccatcagctttcctacagactcagtaattaatttttacagggcttagaactatggtcatgcacaagactagatgaggggttgaagcaaacattccaacagcaaactgagatgggatgtttccttttctacttacaaagaaaataaatagaaatagattttacatgctttatttctttgagacaagccattgtaaattgttactagactaagtagtagtataccagtcattgactggtcttttcaactccactcaaatttgtaaaaagcaattcctcttatactatcatcttttttgtttt

SEQ ID NO: 736115 - DNA, 5292 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736116 - DNA, 2445 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttccttaaaaaaaaaaaaaaaaaaaaaaaaaaggtgaaaactacgttgctcgaagtctggtgccactgtattgatacacattcccatcagctttcctacagactcagtaattaatttttacagggcttagaactatggtcatgcacaagactagatgaggggttgaagcaaacattccaacagcaaactgagatgggatgtttccttttctacttacaaagaaaataaatagaaatagattttacatgctttatttctttgagacaagccattgtaaattgttactagactaagtagtagtataccagtcattgactggtcttttcaactccactcaaatttgtaaaaagcaattcctcttatactatcatcttttttgtttt

SEQ ID NO: 736117 - DNA, 4404 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaaaaatagtaatcattttattt

SEQ ID NO: 736118 - DNA, 6271 bp, Homo sapiens
  misc_feature (2018)..(2018): n is a, c, g, or t
  misc_feature (4691)..(4692): n is a, c, g, or t
cgtttatagataccaaggatgaggatgtggatacctttcggagctattatttagtctcccacactctcccgaagacatgtcccaattcttgtttaggatgaaaactaaaggactcattgccttcccccaggaaagctaggagacaagacaagagaacaaaatccttacattgaacttgcttcttcccatcagcgctggcatggaggagccctcttgcaccaggtagaagttggcagcctgagctctggagccagacttctggggctaaatcctggctctgcccttcctggtagaggaacataggcaggctcccccactcctgccggcttcctcatctggaatgtgggaatggcagtggtgcctagcgttgtggttgttctgaggatgaaaggaatccgcatgtttggattccctgaaaagcggagcctgtgacgtgcacttgagaacaggtgctttatttggggaatgatctctggaggcagaatgagggagtgagcagcaagacaggacacattttggaaaaccagcaggaggtgcatcattgagctagctcgcatggtgggcaacttctgtgaagtcccatcgagcccctctagggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgggtactcagagagcacctttcataacagcgtctgctattattactcaaaagcaacacccaatgtctgctccataccaggacctcctcccccatagtaaggggaggaaagggaagcacctccaccagccagggcacttccctttcctcctccttgggccatgcaacgggatgaaagctcacctttccctccccttttctctctcacctcttcacaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacncccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctagggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgnnaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggctttatggctgtcctttgtcttctacacgctgaccccctccaaggggctggcatcaattgcaaatggctctgcaaatgctgcagctctaaatgaaatgctgattgaaggatcccagcacaatccagttccacctttacatcgtgtagtgctgctccctgcattgaggggatgttgacacgtgatgacaaagtgcattgtgtaccaagtatctctcctccaggacctgaaaggatttgcaaataaatcacacgtgcaattctctcctaaaagcctgctgactgatggtggtaagtaagtggaaactgtggcaggcaagcatgcattccagcctccttttgggctgaggtgaggaaaattctctgtccttcctttgggtctcgagtgtacatacaacaactctggactgggttaaaaagttgattgtagattcctttatcaactgcagccccaagacaattcttagaaatctagatttctagcatcgcttaagaattcagacactggcaaaatggggcttccaatctgacttggcctcgatggggcagagtggcactgaggtttcgagtcctctccacccacgatgtcttctggacccagagttgaccaactccatttatgctccctctcaccactcttctaatacagaagtgtttctcccaagtcacagctctacccaaaagtgggggaaacagagagggaaggagccgtgtgttttcaagatcattcagaaagagctcattgctttacaaaagggaagaaaaatcctgtgtgtctcctaggcaaatatagaatgtcatgtctaaagaacacaactgaagacgccattatgatgcaaaccgtcatgcgatctatgtgcccagaatctgagaaagaactgataggaaagtcttaactgaaatgtccacgaggtgtcttttcgagtgtgaataaataagtgatgcggcttggtttctcttgcacctggct

SEQ ID NO: 736119 - DNA, 1817 bp, Homo sapiens
tgttccaaggaaccagtaattaatgcatggttataggtatacctggcttcaaaaaaaagaagtagccgtggaaagctatatgagaaaatcacaattttctgaatcaaatatttgtaaaaccatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatgcaaaagttattaactgataagcccaatcttgttcaggcacgttcttctaaatgcctggacctaaataacttctgcttgggttaacttgtgtttcattctcaccttaggcctcagtgtggaaaggtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaagatctaaagatcctctttcagtagcatatactaaaattaagtttagtgctcaaaaccctggtaacctacactggcccaaggttacagtaggtaattcaccgtctcacattagacaggccaatgcatcccttaggagctgccccactctcctctcacctaccaaaggattttctcaggtgtggttccaagcgataaagttctactgtcctcggccttccctgctggtaattcgcctttcagattagccaataacactgagctgatctctagggttaagaagagaacattgaactcattttgtccccatgtaccccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattcaccacgaccacattgtttaaaaccacatttctgggttttaaatcagtcagtggctgggcccaaaggcacttttgggtaagataagtgaagaaatgcccacaaggccaaggtgtcacttaaaaaaacaaacaaaaaaaacaagccaaaaaaaaaaattctgtccgctaatgttttgcacgcatctaggagcagactcactgcaaacctctggttatgccattattcaggggtataaagaaagctttagaagtagcatagtcctgatgcctcctctaatgagttaaagctcttgggggaaattctaaaattgccagaccattttgtttctctgtgctcctacgaaaccagtcgggatactgagtgtttggcaatactgccacctactgaaagctgagcttcagagtgaggtgaaataaagacagaatgtaaaagcatctactttgttttaaacagcaaacaaatggaccagattaacaatgatcccatctggaatttaaaactctgaaagtgtcaacattgaaaggattaagcatatcatccggtcaaacttcccaccctacccacatacccaggcaacgtctat

SEQ ID NO: 736120 - DNA, 2334 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 736121 - DNA, 2706 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 736122 - DNA, 2243 bp, Homo sapiens
  misc_feature (2079)..(2080): n is a, c, g, or t
  misc_feature (2084)..(2084): n is a, c, g, or t
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctcccctctatcnnggtncggtccctgggttccttggattgttgttgggcccatttccccgccgtgacatttgtttccaaggttggggccccgcatgaaggcgcggcgctcttccgccttgttgcggcggtgtgtctacacacgcctctccttttaccaggggcagaggctctcttg

SEQ ID NO: 736123 - DNA, 2103 bp, Homo sapiens
gagccgaggcgagcatctcccaccgccgccgccccgcgccccaggcgcccgccccccacccgctccagcgccctgccgcgggccaaacctccccaccatgccccgcaccccgcccgctcctgcgaccccccagccccgctcagtcccgagcgcccgcagtcgtcgcgccgccgcgccaagcatgcagtaaaggctgaaaatctgggtcacagctgaggaagacctcagacatggagtccaggatgtggcctgcgctgctgctgtcccacctcctccctctctggccactgctgttgctgcccctcccaccgcctgctcagggctcttcatcctcccctcgaaccccaccagccccagcccgccccccgtgtgccaggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagccttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 736124 - DNA, 2523 bp, Homo sapiens; identical to SEQ ID NO: 67715

SEQ ID NO: 736125 - DNA, 1917 bp, Homo sapiens; identical to SEQ ID NO: 67718

SEQ ID NO: 736126 - DNA, 421 bp, Homo sapiens; identical to SEQ ID NO: 57105

SEQ ID NO: 736127 - DNA, 1414 bp, Homo sapiens
ctaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgaagaacgggaaccgctacgagggctgctgggagagaggcatgaagaacggggcggggcgtttcttccatctggaccacggccagctgtttgaaggcttctgggtggacaatatggccaaatgcgggacgatgatcgactttggccgtgacgaggcccctgagcccactcagttccccattcctgaggtcaaaatcctagaccctgatggtgtgctggcggagccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataaacctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatata

SEQ ID NO: 736128 - DNA, 1229 bp, Homo sapiens
ctaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgagtcaaaatcctagaccctgatggtgtgctggcggagccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataaacctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatata

SEQ ID NO: 736129 - DNA, 2406 bp, Homo sapiens
tcacattacaagactcgttgaggctaataagcagcggtatctttttctcaagaaggtgaaaaaaatagatatgattctttccttgccttcctcctatgtgaggaatgtgcgtcgcttgggtacatgtggacacttgaaagatatttgatagaattctgggaaaacggaagcagtcagttcctctgagtcaaataagaaacgacacacgtggctctcatcatgtttctattggacagcgctgccctggagcctcggcaagtcatttggcttcttcgcgtctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaagagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaag

SEQ ID NO: 736130 - DNA, 2657 bp, Homo sapiens
tatatttgataatatttttaataattgcataacctttctatatttgttttcaaaagtaaagcaaagcaagaaaaatgaatgaaaaaaaattgttttacttgctagcacaacccctgcagcaacagtgatagtctttgggcctatcaatagggggcagcaaagttcaggactttgggctgcagcagttgaaactagaggatctctggaggagagagtggatcctctctgagtgtgtgttgtgagtgtgtgtgtagatggcaggcaggcaggagctgtggaagagtgtggtgacagttctgcctgaacaacacaggcagtcttctttacctttccttgccttcctcctatgtgaggaatgtgcgtcgcttgggtacatgtggacacttgaaagatatttgatagaattctgggaaaacggaagcagtcagttcctctgagtcaaataagaaacgacacacgtggctctcatcatgtttctattggacagcgctgccctggagcctcggcaagtcatttggcttcttcgcgtctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaagagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaag

SEQ ID NO: 736131 - DNA, 2510 bp, Homo sapiens
aacttttcttggctgtacacccaccaatcacgagtatacagcttaacacattttcaacaaacggaacgcaggtattgacccagcattcagatcaagggccaacgtaaacacactggcaaaggattgcaagagccctgtccacagcagctgagttctgccagattctgtaaattcatgcagccttacacctgcactggccaatactgtaactgctagccacacgtggccaccgagagcttgaaaggcagctagtgccatttgttgaaatgataacgttttggacttactgagtcaaataagaaacgacacacgtggctctcatcatgtttctattggacagcgctgccctggagcctcggcaagtcatttggcttcttcgcgtctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaagagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaag

SEQ ID NO: 736132 - DNA, 880 bp, Homo sapiens
  misc_feature (22)..(22): n is a, c, g, or t
  misc_feature (31)..(31): n is a, c, g, or t
  misc_feature (39)..(39): n is a, c, g, or t
ccttccttcaacagtctgggantgaaagganctctgccnacctttccttgccttcctcctatgtgaggaatgtgcgtcgcttgggtacatgtggacacttgaaagatatttgatagaattctgggaaaacggaagcagtcagttcctctgagtcaaataagaaacgacacacgtggctctcatcatgtttctattggacagcgctgccctggagcctcggcaagtcatttggcttcttcgcgtctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcgggtgaggaccgcggactccgct

SEQ ID NO: 736133 - DNA, 2371 bp, Homo sapiens
  misc_feature (22)..(22): n is a, c, g, or t
  misc_feature (31)..(31): n is a, c, g, or t
  misc_feature (39)..(39): n is a, c, g, or t
ccttccttcaacagtctgggantgaaagganctctgccnacctttccttgccttcctcctatgtgaggaatgtgcgtcgcttgggtacatgtggacacttgaaagatatttgatagaattctgggaaaacggaagcagtcagttcctctgagtcaaataagaaacgacacacgtggctctcatcatgtttctattggacagcgctgccctggagcctcggcaagtcatttggcttcttcgcgtctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaagagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaag

SEQ ID NO: 736134 - DNA, 760 bp, Homo sapiens
  misc_feature (742)..(742): n is a, c, g, or t
ggctaccaaagcattcactgacttctcaaagccatttctactcagaaaagttaaggccactgacatattgaaatcctttgttttatagatgagaaaacttgctcccatggaaagcgggagacctctccagagcgatcaagccagtcagggacccatgcatgggccaggccactgtcccaaagactttgtgcacagcccctcagtgctctctcaagacaaccctactgaggcagccacagtcatcacctctcttgtacagaagagcatgctgacgcccagaggtttcagttacttcaggaatcatgttgcctcatctccagggctatttgcactacactgtgttgtccctacacaaaaataaaaccctgggctgtgctgtggtggtgaagaccatgggcttgccacagccccacacacactcatttcataatggttcattctcttcttcaggcccctcatacattcccccagatgctagtttacccctcctttgtgccaaagaaactttctgccaattgcagcggagctggcctgcctggctcttgtgctggctggacaccctctgctggcagcatcttcatgggcagcagctgggtgacctaagagtgcagtgaagccacacttggacctcacgagagagtgtttctatgctcgaattcttcccacacttagcagacctgtgtttagaatcctggcgttacatttacttattcaaccactttttggtttgtttctttagggntatgttttgtttttaata

SEQ ID NO: 736135 - DNA, 634 bp, Homo sapiens
  misc_feature (6)..(6): n is a, c, g, or t
  misc_feature (23)..(23): n is a, c, g, or t
  misc_feature (71)..(71): n is a, c, g, or t
  misc_feature (78)..(78): n is a, c, g, or t
taccancatagcgtatataagcncatatgtatatattccccctcttttaaaaaaagcacagttggaagctnctatatncacacttctctacatggtgcctgaaatcattatatttggtgattagttttcatatgaccctagactgacctgtctcctttttacatagctacattgtattccattatgtagatatattttatttaacaaatcctctatggatgaatttttagattatttcatctttggctatataaacaatgcttcagtgaatagccttgaatttatttatttgtatatgtgtgggtatctatagaataaattttccaaaaaatattttgcctgactgaaatttgaaatttgacagctactgcccaaattgtcccctaaagtgcatgcacccaattgatccttcccacaaaaggcataagagaatgcctgttttcctgcatccttcccaaccctgcaatattataggattgtaggccctctgtgtccaatcatttgtcctgtgcacagagcaaataggaataatgactggtaaaaaacccttaacctcacaaagcataagggacacagacataaaaacagaaattatagtgcaatgtgggaagtgttctgctaggaaaaaaaaaaa

SEQ ID NO: 736136 - DNA, 907 bp, Homo sapiens
cttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagcccacgcgtccgactagttctagatcgcg

SEQ ID NO: 736137 - DNA, 1876 bp, Homo sapiens
cttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacacacacacacacacatatcacagttgtgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaattttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaattttggttgtatggaaatatgggtagtactacttgtgggaacctgttactgacaattgatgtcattaacaaaatgcctagttggattagatgttttcattttctaattttttg

SEQ ID NO: 736138 - DNA, 1732 bp, Homo sapiens
cttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacacacacacacacacatatcacagttgtgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaattttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaattttggttgtatggaaatatgggtagtactacttgtgggaacctgttactgacaattgatgtcattaacaaaatgcctagttggattagatgttttcattttctaattttttg

SEQ ID NO: 736139 - DNA, 5655 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggatggtctcgatctcctgacctcatgatccacccgcctcggcctcccaaagtgctgggattacaggcatgagccactgcgcccagcctcacaaaatattctt

SEQ ID NO: 736140 - DNA, 3035 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaatgataccagagttaatatccttactgtccaaagagttccttggattccttaagaaaataaggttttgatgtaaaatttggggcaaaggctcaaggggacaaatcagggagggaagaattgagtaaagcaaaggagaaatgggtctaagttcctaataaccttggaatgtgaattaaaacagaaaagtgccattttct

SEQ ID NO: 736141 - DNA, 611 bp, Homo sapiens
gctggtacggcctggaattatgggatgctcgggccgcgctggtgaagtcgcgagacatgcactggtctctcctagctcagcggggccagagggacgtcagcctcagctcactgcgcatgctgattgtggccgatggtgccaacccgtgtgagtgagcctgtgtgcccggcgcataccccacacagtgtcccctcctgcaaaccaaagtagaatacactgagaagcaaaatggaggcattttcactgccattgtcatatagatacacatgtcccatcgtttctatgacacggaacatcttggtgattcactggtttatcccatgcatgtttattaggccactaaatttaaaagcaattttaatatgcttgatgaaaggtacatgccttaatgagagtcatctttcttaagaaattaccagattgtgctgtggcctggggttcctgtttctctttaggcctcatccccaccctcctgccctttgtcctggtgcccccacgtctctggcttctggcttcacttctcccaccaggacccaaccattctccctcctggtttgcctgggtgtcccccacatcctcccaggaggagctccctatggctgctgcctgac

SEQ ID NO: 736142 - DNA, 3122 bp, Homo sapiens; identical to SEQ ID NO: 75374

SEQ ID NO: 736143 - DNA, 766 bp, Homo sapiens
tgctttctgtgcctgtaatttaacttagttcataaaataagagacaatgaatattatccgccccgacttcgttcagtgttttctggagcattattcttggccagtggatgtctcgtgacagaatctgaactcggtggttggtaacacatcacattcttgtcctctgggcccaccagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggaggtgaggggttgtggtgaagccctgcgtgagtgctgtgcggggaggacctgggctccccaagagcttagtcacctgctagcacacctcactccttgctgtggtctggtattgctccttgtggggggaagatgttctgacagcagttttctctgaaaatactgttttccctccatgactgcccctcactgtccttgggcccttggcctctgctgagggcgtgggggacggtgttggtgataaggctaccaggcttctccccgaggccagaccggtctctctgccgctgtgtctttaccagtggcttccccatgcacaacccatttaaggttgtggtcaatgtccagaggactctgtgcagccaccacaagctggccagataaggcagaacttttggtagctcctatagatggtgtcc

SEQ ID NO: 736144 - DNA, 1479 bp, Homo sapiens
cgagctcggtacccccctcacggattacctcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 736145 - DNA, 982 bp, Homo sapiens
tctgagggtacctgtgaaggggccccttccttctgctgatgcagccctgtggttccgatggccgcaggctgcgctaacttgagcatgtccagccaccccttccctgctggccccccagttagtgctggcgttccactcttgttgctctgtgcagggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaacatcttggcc

SEQ ID NO: 736146 - DNA, 2903 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaacatcttggcc

SEQ ID NO: 736147 - DNA, 2797 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccgactcgtcgacgcggccgcgaat

SEQ ID NO: 736148 - DNA, 6270 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggaggtgaggggttgtggtgaagccctgcgtgagtgctgtgcggggaggacctgggctccccaagagcttagtcacctgctagcacacctcactccttgctgtggtctggtattgctccttgtggggggaagatgttctgacagcagttttctctgaaaatactgttttccctccatgactgcccctcactgtccttgggcccttggcctctgctgagggcgtgggggacggtgttggtgataaggctaccaggcttctccccgaggccagaccggtctctctgccgctgtgtctttaccagtggcttccccatgcacaacccatttaaggttgtggtcaatgtccagaggactctgtgcagccaccacaagctggccagataaggcagaacttttggtagctcctatagatggtgtcc

SEQ ID NO: 736149 - DNA, 7803 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaatattatgcttgcggttattgtgatcattatacctgttccacactatttgacaaggacagtgatgcatgcacaccccgcgg

SEQ ID NO: 736150 - DNA, 7870 bp, Homo sapiens
atttgacttaacagccactttcattttgggtgtgtttttcaaaagcagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 736151 - DNA, 3752 bp, Homo sapiens
tcacacaaccaggaagaataagagtggcccctgtgacatttggttctttagagggacagggacagagagaagacaagtaacccatctactggcaagaacgtttcttacccgatgacccatgtgacatttggtttttagagggatagggacagatagaagacaagttatccatctactggcagaacgtttcttacctgatgctgtcataggatctgacttagtttcatcttgatgaacgatggtggtgcatacagtgtgtgcttgctggtctgtggtcagatgtgtatcagggcccctcccagctttgaagctcagatcccagtcctggattctcaagtatggccacactgtagcttgatgtaaacactaggtttagcttactgggtgccaggggcttgctgggttcagggaggacctaaacgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttcccttaatttttagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 736152 - DNA, 3107 bp, Homo sapiens
gacgttattttaatgtcactgaatcaagagagtctcgtgtcatgttttctttaacaagggacatagctctcctccttccagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 736153 - DNA, 550 bp, Homo sapiens
acattttgatagtgcaaaaatgaatttataaatagatgcaaaacgggtcagtatctgcagagcaatagccatatttatattctacaggataaaatttgcatttatttgcatttctttggaaaagaaatttgcattactcaaagtgcactactataagatttctacaatttacagagataagtagcccaaagacgatggaaagcgcgggtccctatcgaatcagataaccctgaagggcgctagatgagacactcagtaatcctttttatggcacactgcaaagtctttcacaattcttacctgacagtctccctccacaggatcataataatctcaaagaaagatcatttttgatcataatcgataagcattttagagagtgggccaaatgctttcattattcaacagaattctcagcctggtcacagggtccccactgtcaagccatcaagaatccctgcactctctcaatgcagggatcccccaggcttccctcatccgccacctggcctgaccctctgccctcctcaatccaccaggtgggtgcctt

SEQ ID NO: 736154 - DNA, 392 bp, Homo sapiens; identical to SEQ ID NO: 466553

SEQ ID NO: 736155 - DNA, 754 bp, Homo sapiens
cctggcatgatctgatcgcctttgaagcagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaa

SEQ ID NO: 736156 - DNA, 1002 bp, Homo sapiens
ccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaagtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaa

SEQ ID NO: 736157 - DNA, 1249 bp, Homo sapiens
agtattttcttcctttttttggtaaactttcatttttaaccttgttccttaatttattttacatttttaaactttaagaatttaattttctttgcttttaatttttaaaattctgaaacttctttaaattaaaaaattatttttaacttttaaaatatttcttttaaaaataacaacttaaatttttttcaacatttaaaagtttttttcttttaaaatcttaaaaatgattttttcctttttaaatgtttttcttttaaagctctttaaactttattttaaaatattatttttctttcaaactatttagctggtcagccacagctggaacaccaattgtgaagtttttgctgataaaggaatactccctgacttcacaagatatttctgtaaaaacaaatgacatagagtagcatcagaacacttctactcccgttgtccccacctaaagcattcttttcatttcattatgctttatgtgaccattttcaacctcttctccctctccccatttcttaaggttgaatggtcactggttagtattcatttttttcttccgacagacccatgggccatgctaaaataggttctttatatcaagatactagctgtcacataggtgttactgtcattgtccattccaagtaggtctgtgtgtcacttcaaaatccttgcctaatcatttacttttttttcagtaagtggtctggtaagactagtctttctctagaccctgtttgtgatagaacagtaaatacccttcactgtagagtaagtcctcaatggtagccttggtgatgatggcatcatcacagctgaaccactggtccttttgttgccggatgaagctggtatagtggccactttccaaagttccatggtgattaatcactgcaaacaaggaatacttattctcattgggcacacaatctgttggtggctggccttctttcattctgctctctttagtagaggccaaaaacggagtcatgtccagctccaagggaaaggagataaaggtattaatctttcgcctctgtttgcctacatgctcaaaccgcttgagatgaaaacaagccacaatgggtaattttttcattgtgagctgtttagtagactcctggtagctttggcaactattgcatttgattttggcactgcttcctaggtgctctggccttgtaaaccactgtagacagtctgtaagtgaggggattcctggtatgtggtcatccctgctcactgtgct

SEQ ID NO: 736158 - DNA, 683 bp, Homo sapiens
agtattttcttcctttttttggtaaactttcatttttaaccttgttccttaatttattttacatttttaaactttaagaatttaattttctttgcttttaatttttaaaattctgaaacttctttaaattaaaaaattatttttaacttttaaaatatttcttttaaaaataacaacttaaatttttttcaacatttaaaagtttttttcttttaaaatcttaaaaatgattttttcctttttaaatgtttttcttttaaagctctttaaactttattttaaaatattatttttctttcaaactatttagctggtcagccacagctggaacaccaattgtgaagtttttgctgataaaggaatactccctgacttcacaagatatttctgtaaaaacaaatgacatagagtagcatcagaacacttctactcccgttgtccccacctaaagcattcttttcatttcattatgctttatgtgaccattttcaacctcttctccctctccccatttcttaaggttgaatggtcactggttagtattcatttttttcttccgacagacccatgggccatgctaaaataggttctttatatcaagatactagctgtcacataggtgttactgtcattgtccattccaagtaggtctgtgtgtcaccgacggcgcgggtcgacgatat

SEQ ID NO: 736159 - DNA, 1357 bp, Homo sapiens
ctaaactatttaaatcctatccattcttcaagaaatgtttcatgacgcttccttaactgctaaggacccgcagattctcttcctcttgggactcacacactgactcatctcccgatcttttggtgctcagcaaagtggaggcctctgttttggacttagagtcaagaccattaaataagactatgctctaaaaagtacacctccgtggcccggaacgagtgaattaacatctatgagtttccatttccttgtctataaaattgtgaaattgcaacttaagattagttctgaagattaaatgaggtaacataggtgaaaatgctacatttatgtaagaaattactctttcataaggatgtcaatgtttaaatacgcattttctcaattttgttaatgaaatactttgaaattcttttttctaatgaaacctgctgaatgtaaaagagacccgtactaaagaaagataccacatgaagcaccaagggtctctttctggatctatcatgactcttgtgactgtttcagcagcacagaaattaaaggcgattgttattctggaggaagacaatgagtctcatctatatcttgtttgggttgattttgtaaacagaacattccaaagatcattcttgccttttgtttccactgagaactagaataaagtaaaacaaactatcaatttaaggaaagcctcgaaattgttagcaatttcttcagtaactttcatccatcaactgattttatgaacacaaatttgcagaaatgggcaagaaaaactacttaactcattggtgggaagcagtgggctctctaaggagggagagatagcagtgatttcaccaccggaccgtggaacacaaagagcctggaagagtctatcactttcaactgaaaccgcaagaagaactaagtaggttaagccctaagaatgttcctaggtaacctacttgagttgaaatttgactaaaaatccttacaccctacctaagagaggtaacgcctattaggatcggaagtgattggaagctttgtttcagatctcgtcccaaaagggagaacggtcaatgacaaagctgctgtgaatagtattctgggggcgtggtggaaccccgattcactgctatctcccgaatcagcaacttgacagagcgcgcctcccgggccttggaagccttccattccgagctggctgggtgggactcaggttttacggtatgctggactttttccccgtgagttaaaacacatttatagtaactaagtggttaatgatgagaaaaaaccccaaactactgtactaataatcaacctctgctatttggtttgtaaaaaacaaaaatacatctataaaaaggga

SEQ ID NO: 736160 - DNA, 2110 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacagtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagactcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggtaa

SEQ ID NO: 736161 - DNA, 668 bp, Homo sapiens
gccggatctgccgctccttctcctgctcctgcaggcgctggatggcagctgcctctgcacctccaggtactcctgcttcttctgccgcattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggtaa

SEQ ID NO: 736162 - DNA, 532 bp, Homo sapiens
ctcggctctaccttgtctgagacaaggtcttactctgcactctagcctggacgacagagtgagactccgtctgaaaaaaaaaaaaaattaaccgggcgtggtgacagacgcctgtaatcccagctacttgagaggctgaggcaggagaatcacttgaacctgggagatagaggttgcagtgagccaaaacggtgccactgcactccagcctgggcaacagcgcgagactccatctcaacaacaacaacaacaaaaattactcatagaacattttccaggtcaggaaagatgagaagagctggatagacctttccagatgtaagacccccaaagctaaatatgccgggtacgtttaaggcccctttaaggtggataactccccctctgccctcagcccagaaaagcttgtttccaataggccgtggctggagggtggggaaatgtcccatccttcgcggaatgtgtgggattgtgggtcagttccatggggtacctgcttgccccagccaccagtgagtacccactggagaga

SEQ ID NO: 736163 - DNA, 549 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacagtaagtaccacccctcttccccaagcatttcaggtgcttctcgtggtgacaagcactggcatctctgtagatgggtgctgctgttgttatcatccccatcctaaagagcaaactgaggcacccagagtgaagtcgcttggcctaggtcacatagtactcttaagcaccatactctgccattctagacttttctatcctttgcaaacacccttgccccacctcacctcctttggcttttcttcctaggacctttggtcagtgggcccctcctgaccaaaggagttcattctcctcctggactccaagcctgcggcctcttc

SEQ ID NO: 736164 - DNA, 2221 bp, Homo sapiens
  misc_feature (831)..(831): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccngcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaacacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacaggtaggcacattgccgggttctggacatgcccccagagcagcctctgcccaccccttcctgggtccctgactccgtccccctccgtgtgcccctccccag

SEQ ID NO: 736165 - DNA, 5337 bp, Homo sapiens
  misc_feature (831)..(831): n is a, c, g, or t
  misc_feature (5241)..(5241): n is a, c, g, or t
  misc_feature (5243)..(5244): n is a, c, g, or t
  misc_feature (5259)..(5259): n is a, c, g, or t
  misc_feature (5269)..(5269): n is a, c, g, or t
  misc_feature (5274)..(5274): n is a, c, g, or t
  misc_feature (5283)..(5283): n is a, c, g, or t
  misc_feature (5300)..(5300): n is a, c, g, or t
  misc_feature (5303)..(5303): n is a, c, g, or t
  misc_feature (5309)..(5309): n is a, c, g, or t
  misc_feature (5337)..(5337): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccngcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaacacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaactgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736166 - DNA, 3499 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaccaagaacgaaaaccccccaaacccacacactccccccaaccacctag

SEQ ID NO: 736167 - DNA, 3779 bp, Homo sapiens
  misc_feature (3683)..(3683): n is a, c, g, or t
  misc_feature (3685)..(3686): n is a, c, g, or t
  misc_feature (3701)..(3701): n is a, c, g, or t
  misc_feature (3711)..(3711): n is a, c, g, or t
  misc_feature (3716)..(3716): n is a, c, g, or t
  misc_feature (3725)..(3725): n is a, c, g, or t
  misc_feature (3742)..(3742): n is a, c, g, or t
  misc_feature (3745)..(3745): n is a, c, g, or t
  misc_feature (3751)..(3751): n is a, c, g, or t
  misc_feature (3779)..(3779): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaactgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736168 - DNA, 3798 bp, Homo sapiens
  misc_feature (3702)..(3702): n is a, c, g, or t
  misc_feature (3704)..(3705): n is a, c, g, or t
  misc_feature (3720)..(3720): n is a, c, g, or t
  misc_feature (3730)..(3730): n is a, c, g, or t
  misc_feature (3735)..(3735): n is a, c, g, or t
  misc_feature (3744)..(3744): n is a, c, g, or t
  misc_feature (3761)..(3761): n is a, c, g, or t
  misc_feature (3764)..(3764): n is a, c, g, or t
  misc_feature (3770)..(3770): n is a, c, g, or t
  misc_feature (3798)..(3798): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaaaaaaaaaaaaaaaaaaaagctgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736169 - DNA, 3742 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaatcgatgtcgactcgagtcaggctgcggatccgatgtttgggcatatggcttaggattgacttggcgatgtcgactcgagtcagtgcggatccgacgtttgggcgttcgggcggagcgaattcgatgtgtgggcgtacggcttaggattgacttggcgatgtcgactcggtcagtgcggatccgatgtctgggcatacggggcgatgtcgactcgagtcagtgcgaattcgatgtctgggcatatggggcgatgtcgactcga

SEQ ID NO: 736170 - DNA, 3779 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaacacaacacaacaccacaacaaaaaattggtgtgggccggccgtggcgacacagaaagaaagggcctttataaacaccactccggtgtgtgggcgcgcgcgggcaccccagagagggtaaggctgacagtgggcaacaggggggccccaagagaacactggggccacgacacacgtgggcgttgttccccccaaaaaaaacgcgccggggggcacaccggcgcgttgggacacaacaccaagatgaggtcggaagggcgacagcgggccatacaaaggggagcaaaagggacccgaatataaattaccgagcgcgtaggac

SEQ ID NO: 736171 - DNA, 3769 bp, Homo sapiens
  misc_feature (3673)..(3673): n is a, c, g, or t
  misc_feature (3675)..(3676): n is a, c, g, or t
  misc_feature (3691)..(3691): n is a, c, g, or t
  misc_feature (3701)..(3701): n is a, c, g, or t
  misc_feature (3706)..(3706): n is a, c, g, or t
  misc_feature (3715)..(3715): n is a, c, g, or t
  misc_feature (3732)..(3732): n is a, c, g, or t
  misc_feature (3735)..(3735): n is a, c, g, or t
  misc_feature (3741)..(3741): n is a, c, g, or t
  misc_feature (3769)..(3769): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaagctgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736172 - DNA, 3374 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgcatgaactcgccgcgggtggatactctagagtcggccatgac

SEQ ID NO: 736173 - DNA, 3434 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttattgtccacggaccgagcgattgctcaagaatgatacaaagcatcagagacatgcgcagtctgcttgtcaactttcaacaactcttgtgtgttcccagcaccggaaggtctcagacttcatattccactcgtgcc

SEQ ID NO: 736174 - DNA, 3311 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatcccatgcggtggtttatcctcaagagtcagccacacat

SEQ ID NO: 736175 - DNA, 3144 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagccagcagcaccagcacgaagcccagccgat

SEQ ID NO: 736176 - DNA, 3229 bp, Homo sapiens
  misc_feature (3133)..(3133): n is a, c, g, or t
  misc_feature (3135)..(3136): n is a, c, g, or t
  misc_feature (3151)..(3151): n is a, c, g, or t
  misc_feature (3161)..(3161): n is a, c, g, or t
  misc_feature (3166)..(3166): n is a, c, g, or t
  misc_feature (3175)..(3175): n is a, c, g, or t
  misc_feature (3192)..(3192): n is a, c, g, or t
  misc_feature (3195)..(3195): n is a, c, g, or t
  misc_feature (3201)..(3201): n is a, c, g, or t
  misc_feature (3229)..(3229): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcggctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaactgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736177 - DNA, 2721 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgtttatttcacagggatcctctagatcacctc

SEQ ID NO: 736178 - DNA, 2901 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttgcttgcttttttgtttttttagagatggggtcttgctatgttgcccaggctggtcttgaactcctgggctcaagtgatgctcccacctcaacctcccaaagcgctgggagtacaggcatgggccactgctcccaacctaccctgctttttttttcttttttttttttaataaagaatgtggtttatacccagttgatgaggaaaaactc

SEQ ID NO: 736179 - DNA, 2592 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacagcatcacccgttcgggatcctcatg

SEQ ID NO: 736180 - DNA, 2615 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacagccatggaattcttccatcaccaccaggatcttccgggatcctctgat

SEQ ID NO: 736181 - DNA, 2594 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaaccagattcatcaccaggaatgcttac

SEQ ID NO: 736182 - DNA, 3033 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggctagttcttgaaggagccccatcaatcctattaatcctcagaattccagtgggagcctccctctgagccttgtagaaatgggagcgagaaaccccagctgagctgcgttccagcctcagctgagtctttttggtctgcacccatgtcaagaggcgagctcctgttcacccaggccatcatgttgtcactatcgcaccaaccattcgccgtagccggagtaaatcccctgagcttcgcacgtctgatgtttcatacgctctaacaccttgaccctcgatctcttcttcgcttcttggcactctctaatctacctctaatcgctctcacaaaccttcgatcatattcactccataggctctcacacctacatccgccccacacaaataaaatcacacataacccctaacacacgcacaccacaataatacacttatctcactaacatcttatactaacctacccctacttcaatctcatcaaatataacacccacagcaacaccgaaacaccatacactccacgcaacaacatatcttatctccgcatcaacaaagacacaaatgccaacaacccaacaccctaacactaataaaatacttataccaaatgtatacataccactctactcaaccaaccagatctcactccacacaccctctctccatactccactcatataaactccactacaacatccatcctaccaactatcacataata

SEQ ID NO: 736183 - DNA, 2246 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgagtaggtcgtagcggaatcgggggtatgatgttcgaattcataagaacaggaaggttaaaagtagggtcttggtgacaaaatatgtagtgtagagtt

SEQ ID NO: 736184 - DNA, 2155 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccacggtcaacccacaagccacggcaacccacaagccacggtcaacccac

SEQ ID NO: 736185 - DNA, 1860 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctccaaaatccttcccttcctaggctggacttcttactatgcttagctggcgtcacatgcagaaagccccgtgcagagatggc

SEQ ID NO: 736186 - DNA, 1535 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccaccccccacagagcgagctcgggatcctctagatcaccatcagcacacca

SEQ ID NO: 736187 - DNA, 858 bp, Homo sapiens
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagccttttaacacatgaacagctactgacatacccatcctgaagacggactgggtacca

SEQ ID NO: 736188 - DNA, 3756 bp, Homo sapiens
  misc_feature (3660)..(3660): n is a, c, g, or t
  misc_feature (3662)..(3663): n is a, c, g, or t
  misc_feature (3678)..(3678): n is a, c, g, or t
  misc_feature (3688)..(3688): n is a, c, g, or t
  misc_feature (3693)..(3693): n is a, c, g, or t
  misc_feature (3702)..(3702): n is a, c, g, or t
  misc_feature (3719)..(3719): n is a, c, g, or t
  misc_feature (3722)..(3722): n is a, c, g, or t
  misc_feature (3728)..(3728): n is a, c, g, or t
  misc_feature (3756)..(3756): n is a, c, g, or t
cccatggcaacagcctgctatgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaactgtggtgcggcgcggccctgggcccctcgaaaaaagtttttaaaaccaatcgcgtgtggggcggcgcggggcgcccaagagggtaaggggagaacgtggcgccaaaagcgtggtcccaagagagaaacccggggccaaagacaaagggcgcgggggtttccacccacaataaaaaaaaacgccgcggggggaacaccgcgcngnnctggaacaatcccanagggggccgngggcnatccgggcntacaccggggtccaagnggncgatanaatagccgcccgagagagaaaaaaacgn

SEQ ID NO: 736189 - DNA, 1294 bp, Homo sapiens
cgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagta

SEQ ID NO: 736190 - DNA, 1212 bp, Homo sapiens
cgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagta

SEQ ID NO: 736191 - DNA, 2279 bp, Homo sapiens
cacctcatgctttaatataaaggggaggaaccggaatcacgatccccaccaacggcccggaattttgggttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagcatttgcatttgcccttctgtttctgtgaggccggcagcccttggggctggggagagcacagcttgccttggacttgcttctgaacacgaattcttcgagaactaggctcagatgctctgctggagtgttggcctcaccccagtccccttgccagcaacatcactgcccttggacgagactcagtggaagacacttcccctcggacccgttcccaggaggtgcaggggcccagcaataaacggcgaaaggggccttggctcttgccctgtggcagtgaccttggggtccgtactatgcccaggtgtcagcaggaaacaaggccttgctcacaggagcacaggctgtaccaccacaaggagcc

SEQ ID NO: 736192 - DNA, 1005 bp, Homo sapiens
tctttccacggaaggggaaagccagtggcttctgtccaaggaaactgaggtctctgtctctttccctccccagagacgtgcgcagtcaataacggaggctgcgaccggacatgcaaggacacagccactggcgtgcgatgcagctgccccgttggattcacactgcagccggacgggaagacatgcaaaggtcagcatgtggagctgtgtgggtgcccctgcctgtactggcctggccaagagcctccgtgtgcttgcatagccgggcccagggctgggctgaacgggggccacgtgtagctgtgggaaaggacacgtggcaatcatttgctttgctgttggagaggccaggaagagggagggctggccagcagcagggtccccagcagagttcgagagaacacaggtcccacggcacatcagcaggttccttctgtacagagcggtgccagtgacactggacagggcccttcaggtacctggctcagcaaccatgcccaggacgggctctgcagatgctggaatctgcgtctggcaggtctgctgagacgtggctggtgaccaacaagagctgatcttcccattgtcctccttggaagggcctcttccgctacctcctttttgcttcttttgaagcctcttgaaccaggtgctttccctctctaagcctcagtctactcctcaaacagaggcaaaaacacctactttttgaaaaaagtttcttgagcgctgaccaagcaccggcaccgtggaagtgttttttcacctagtcctcgtgatatccttcaaaatgggtgcacttcctgtcctcgctctgcaagcaggagaccaaggctcaggggtccgggagcttgccgaggtcaccagaagtggtgcctgcctgctccagcctccctgctggccaggcggcctccctgaacctgcagaagagaggacatgggagagtcgctgtccctgctttcttgccgggcacagcagccatcagttcctctctactcaatgtct

SEQ ID NO: 736193 - DNA, 3693 bp, Homo sapiens
atgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccctccactcagacggtcgcacgtgcatcgagaaggatgaggctgcaattgagcgctctcagttcaatgccacgtcagtagctgatgtggacaagcgggtgaaacggcggctactcatggagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaacgggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggggggagcggccctgcctgggggtggcctggtccgcggagggtgcacctgccctccacagtgggagctgcatgggcctccacaccaccttgggaaccccatggcactgcccttcagggaagccgaccagcccatggagaccgagcccaggcacccttcggacccgctgcccctgtgggagcaccctgcttcaggaagcctccctccctccctctgcctcccttccccaggacaccaagagcgccctctcctgagccctggcagaccgactgcaggtagcaggattgcaggaccctctgcctggcctggcgtttcaggagagaggggaagtggggcctgtgctctgggaggcgtggtcatccgagacaggagtccaggggagagaggaggggacaaaggcgccgtctgggggaggtcgatgagcctgtgctggcatccgcgggccccacgctttgccaactcctccagccacaggcaaggccacggctccgggctgttgcgctctaagggttctgtgattggatggaacagagctgctggggaggagactggaagtttctgcattccttcaacagaacatttaatgaagtactctatatatatatataaatatatatataaatatatatatatacttctatttgtgggtactttaggaaaatgccctttggtcactgtaaatatgaattgtgaccccatcccttcccgcatgagcccagtgagtcccagcagctatcagcctccctgaacgattaaacagctcctcccagcatttgcatttgcccttctgtttctgtgaggccggcagcccttggggctggggagagcacagcttgccttggacttgcttctgaacacgaattcttcgagaactaggctcagatgctctgctggagtgttggcctcaccccagtccccttgccagcaacatcactgcccttggacgagactcagtggaagacacttcccctcggacccgttcccaggaggtgcaggggcccagcaataaacggcgaaaggggccttggctcttgccctgtggcagtgaccttggggtccgtactatgcccaggtgtcagcaggaaacaaggccttgctcacaggagcacaggctgtaccaccacaaggagcc

SEQ ID NO: 736194 - DNA, 737 bp, Homo sapiens; identical to SEQ ID NO: 224208

SEQ ID NO: 736195 - DNA, 1866 bp, Homo sapiens
aaagccttgagagagcgttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaaacatttcaagggagctagaggcaatgttacagtggagatcagagaagggatggggcagtgagctcttgtccctaggggaaatctcttttcctccacgtgacaggagccagtgctccaacagcatcagaattacacttagccacaatgactgatgcgtgtgtgtgcctgtgcacatgtgtgtgagcgtgtgtgtgagcgcacgtgtgtaagggggtgatgatggaaacatgatatgcatccactatggggttgcgttgcaaattcacagctgcacccctcccaaagtcacatggcagaggggaaatggtcatagctttcctgtgtgatgtcctctccagggagcaccgacgactcaggcttgcctcagctctgcgaggcccagactccacactcctccctggggccggctctccttcctcttgactctcagatccccagcccatccacctccaagttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacaaaagaaataagttgatttcattcttttgatttatcttgtttctcattggggtcgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcactttatattcaaaaaataaagaaacctaccacaaattatcagggttaaaa

SEQ ID NO: 736196 - DNA, 1762 bp, Homo sapiens
  misc_feature (1561)..(1561): n is a, c, g, or t
  misc_feature (1563)..(1563): n is a, c, g, or t
aaagccttgagagagcgttttcaaggatcaggagagggcttagaaagaaaaggactctgagtggggctgcatgaaaagggggtaagtgaggactcttggggagggtctgaaaaaaacaagtagtttggcaaggagagcagaaaaataaaattccactgtgtaggcatttggagatttagcaagagcaacctagagtctgcccccagagacactgcacgttgtttctgacacagaggatgcactaattctatttcctgtgccacctgaaaaaatcataatttgagaagagaaactgttaggccatttctagtgaactatttttccaaaccctcacggaaccctgaacagggtgtgaatgagatcacaactactgctgctgctggttcagcctctctgtccactaataaaggcaaacccttcagcatggtcatatcctgccagccgttttcccccaaaagattaaattatgttcatcttggctcatctaacgccacatcttgagttcttaaggtatcacagccaactcagtcataccttactttatgcactgagtacgcattaaactctatttaggaaggaagagggaagcaaaggaagccagggatggttttgtcatgacctctctttgctttctgacctcccggaatccactctttggaagatgtgcagaaaacaatgtgacttccatttaccctgcctcagatctcccctccttcagactggctcccacccctggttaatggggtaacctgggtacgcctatttgttaaaggaatttgtgggaagtgaggggcaaaattgttggagcagagggaatagatttatgggagctttgttacccagtgactatcccagcattaatacttcagagtagccctgacgcttgtggaaacatttcaagggagctagaggcaatgttacagtggagatcagagaagggatggggcagtgagctcttgtccctaggggaaatctcttttcctccacgtgacaggagccagtgctccaacagcatcagaattacacttagccacaatgactgatgcgtgtgtgtgcctgtgcacatgtgtgtgagcgtgtgtgtgagcgcacgtgtgtaagggggtgatgatggaaacatgatatgcatccactatggggttgcgttgcaaattcacagctgcacccctcccaaagtcacatggcagaggggaaatggtcatagctttcctgtgtgatgtcctctccagggagcaccgacgactcaggcttgcctcagctctgcgaggcccagactccacactcctccctggggccggctctccttcctcttgactctcagatccccagcccatccacctccaagttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacgcgtgtncncatctttctactttgctccttctcttctcttccttttcttctttcttttttagtttcctgttctctcttttttatgctttctttagctctatactcctttacttttttttctcttttctctgttctctacctcttcatcttctattcttttataactatcgtccttattcttctctccctcctgctctccttttcgtcc

SEQ ID NO: 736197 - DNA, 1425 bp, Homo sapiens
aatagaatggtattatcacttatactatgttaaaaggagacaagaatattctttgtcttctatggcagcagggaaaggaaaaagagaaactagatcttcagagcaccttgatttctaacacagatttcagcaacctccactgctaaacgctagtccatgtgccactctctccttgcaaacagatttttctggtcacctgtttatggcaagcctgatctcaggaagctagaaaagttcagttctcctctagaacaagcccttgctcacttacaaggttcccactgagcccagaaaggctgacaatgtcttccccacattgcctttcacagcttgctgggataaagaattcgctaaatctgaaaatgagccaggcttggactaaccaaagtgtcttaaagctcccccaacctgcccgcctttttttttatggtaaccagcaaaactcaacagagtttgactcaacagggccaaaactcagttacatttgtatgactctgcaaagagaagtcagctatagtagggagaaaaggaagaaggcaagaaaaggagactcgagatgagtttacatccaagagaagcacagatgtttgtaatctacctagaataatgtgaagtacctgtccagcatgtatgctcagatcctccattcattagcacaagctgaaaacatgaactgcaaattctacaccagcatcctttgcttcctccatggcagtgggaggtagcaaggggagtccaacacttctccatgacgtaagaaaggcaggaaaaatactgatgagaatcaaactgtgtgccaaaaacagctattggggtatttgctgtcctcatcatgttaaatcatacaaagttcttcccagttgatgcagatatgtttctttcttcacattaaagccaaaaaactgataggcattggtggttcacacctgtaactccaacactttgggaggctaaggtgggaggatcgcttgaagccaggaatttgagatcagcatgggcaacatagcaaaactccatctctacaaaaaattttaaaaaaattaactgggcatggtgccatacacctgtagtcctagctacttgggaggctgaggcaggagggttgcttgaatccaggagtttgagtgtgcaatgagctatgattgtgctcctgcactccagcctgaacaacagagtgagactgtctctaaaaaacaaaacaaacaaaacaaccaaaaaaacttgcatatcttgcagaagtcgctccagggttcatagcacagaattaaagcactaaaatagatcaatgcagcataaaggcaattaaagtaaaaccatatgagaaatgggaagctgttatggatggttctctccaagtataaacactgatgaatgtgctcacaccctgcatgaaaaatcaagtaggtccccacgtcaagacgagga

SEQ ID NO: 736198 - DNA, 3367 bp, Homo sapiens
agggggtcaaagtggtcgagtgtcgggaggaaggactgcttgtgtgcggggtgggggggggtggtggagagcgggggcggggattcagcgcgtgtatgtaaaggtgcagcccgtgtgctaggcgctgggtgcgcgcgcggtgtctgctcgggtgcgcgcgcgcgccgctgcccgcctgcccgccggcccgcctgctcgcctgctggggctgctccgtgggtttgacgggcgagcgggcgcggaggagctctgtccggaatcacatagataccatcgtggaaacagcagcgcaggtcacggcgccgcgggccctgcaccagacgctgggctctagagattatttctctttattcagaagcatacagttgtttgctgattgcaagaagatgtttctgtggctgtttctgattttgtcagccctgatttcttcgacaaatgcagattctgacatatcggtggaaatttgcaatgtgtgttcctgcgtgtcagttgagaatgtgctctatgtcaactgtgagaaggtttcagtctacagaccaaatcagctgaaaccaccttggtctaatttttatcacctcaatttccaaaataattttttaaatattctgtatccaaatacattcttgaatttttcacatgcagtctccctgcatctggggaataataaactgcagaacattgagggaggagcctttcttgggctcagtgcattaaagcagttgcacttgaacaacaatgaattaaagattctccgagctgacactttccttggcatagagaacttggagtatctccaggctgactacaatttaatcaagtatattgaacgaggagccttcaataagctccacaaactgaaagttctcattcttaatgacaatctgatttcattccttcctgataatattttccgattcgcatctttgacccatctggatatacgagggaacagaatccagaagctcccttatatcggggttctggaacacattggccgtgtcgttgaattgcaactggaagataacccttggaactgtagctgtgatttattgcccttaaaagcttggctggagaacatgccatataacatttacataggagaagctatctgtgaaactcccagtgacttatatggaaggcttttaaaagaaaccaacaaacaagagctatgtcccatgggcaccggcagtgattttgacgtgcgcatcctgcctccatctcagctggaaaatggctacaccactcccaatggtcacactacccaaacatctttacacagattagtaactaaaccaccaaaaacaacaaatccttccaagatctctggaatcgttgcaggcaaagccctctccaaccgcaatctcagtcagattgtgtcttaccaaacaagggtgcctcctctaacaccttgcccggcaccttgcttctgcaaaacacacccttcagatttgggactaagtgtgaactgccaagagaaaaatatacagtctatgtctgaactgataccgaaacctttaaatgcgaagaagctgcacgtcaatggcaatagcatcaaggatgtggacgtatcagacttcactgactttgaaggactggatttgcttcatttaggcagcaatcaaattacagtgattaagggagacgtatttcacaatctcactaatttacgcaggctatatctcaatggcaatcaaattgagagactctatcctgaaatattttcaggtcttcataacctgcagtatctgtatttggaatacaatttgattaaggaaatctcagcaggcacctttgactccatgccaaatttgcagttactgtacttaaacaataatctcctaaagagcctgcctgtttacatcttttccggagcacccttagctagactgaacctgaggaacaacaaattcatgtacctgcctgtcagtggggtccttgatcagttgcaatctcttacacagattgacttggagggcaacccatgggactgtacttgtgacttggtggcattaaagctgtgggtggagaagttgagcgacgggattgttgtgaaagaactgaaatgtgagacgcctgttcagtttgccaacattgaactgaagtccctcaaaaatgaaatcttatgtcccaaacttttaaataagccgtctgcaccattcacaagccctgcacctgccattacattcaccactcctttgggtcccattcgaagtcctcctggtgggccagtgcctctgtctattttaatcttaagtatcttagtggtcctcattttaacggtgtttgttgctttttgccttcttgtttttgtcctgcgacgcaacaagaaacccacagtgaagcacgaaggcctggggaatcctgactgtggctccatgcagctgcagctaaggaagcatgaccacaaaaccaataaaaaagatggactgagcacagaagctttcattccacaaactatagaacagatgagcaagagccacacttgtggcttgaaagagtcagaaactgggttcatgttttcagatcctccaggacagaaagttgttatgagaaatgtggccgacaaggagaaagatttattacatgtagataccaggaagagactgagcacaattgatgagctggatgaattattccctagcagggattccaatgtgtttattcagaattttcttgaaagcaaaaaggagtataatagcataggtgtcagtggctttgagatccgctatccagaaaaacaaccagacaaaaaaagtaagaagtcactgataggtggcaaccacagtaaaattgttgtggaacaaaggaagagtgagtattttgaactgaaggcgaaactgcagagttcccctgactacctacaggtccttgaggagcaaacagctttgaacaagatctaggtcatgtaatcttacttcatacagaggacatttatttaatgatgaaagtgccttttgttgacttctaacttccaaatactatattatcaataggcatggaggcaggtgtttccaagggtgtctcattaactgtagctgcaaagatgtgtcaagtagaagagaatttgtttaatagattttactacataaaacctatactgtggagtcctgtggggatactgcaaactctattgccaaagggatgctttatacacataatactgaatttaacctcaagaggcaaatctgttttgtaccccaatgcaaaaccttcgtctctttgtgctttgtaaagcaaactcaagaaaactggtacacctgtaccagctgggtcctttatcttgcacgtagattaagttggtggaactggaataatccttttgatttgtggcattgtaacaactccgtgtaaagattatctgaaaagt

SEQ ID NO: 736199 - DNA, 2355 bp, Homo sapiens
aggagtttggctcaaggctggggctagtttctttcagtattttagacaacaacctaaacacctctatcagtgcctgggaatgttcaaggccctggcttggggtcaagcctgcaggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccata

SEQ ID NO: 736200 - DNA, 3281 bp, Homo sapiens
ctgggcaatggcgggcgcctctcccccagcctcgctgccgccttgcagtttgatctcagactgctgtgctagcaatcagcgagactccgtgggcgtaggaccctccgagccagctcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgacagctccttaaatgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccata

SEQ ID NO: 736201 - DNA, 3439 bp, Homo sapiens
ctgggcaatggcgggcgcctctcccccagcctcgctgccgccttgcagtttgatctcagactgctgtgctagcaatcagcgagactccgtgggcgtaggaccctccgagccagctcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgacagctccttaaatgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacataattctcatttccataaaaaaaagaagggggggctagagatctggagggccaagttagggtccgttttgtaaggggccaagggggtttaaagaagggggggtaaagtggggaaaggggactggagacttcggggggcatggacccaataggcgaaaatggatggagatgggaaggatac

SEQ ID NO: 736202 - DNA, 2056 bp, Homo sapiens
ctgggcaatggcgggcgcctctcccccagcctcgctgccgccttgcagtttgatctcagactgctgtgctagcaatcagcgagactccgtgggcgtaggaccctccgagccagctcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgacagctccttaaatgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatattgacacatatttaccaaccagtgccacgcctgacccagaaccttctcacttgaacaccaggaatggacttaaaggctttatggcgttcaggcttagactgctaaggtacgagttcaacctgattcatcagattaagctaaatacatacagccttgggtgtaggtggtatttacattaggactcctccctctcctatagaaactgtttctcaagcccaacttagggagagagcagcaggcaggaacaggacgatcacaaccttcatttctcattagtttctac

SEQ ID NO: 736203 - DNA, 2071 bp, Homo sapiens
gttttctcagacaggatcctaggatgtgtctggaagcctgcggagtgaaggtagacatgcaggtgtgatgttctgcctgatagtgcctctctccaggcattaactacaaggctgggtgggggcttacggtaaggcatcgagtccctaagcatttatacagtcccaattgtgcatcagtgcagtgctggttataacagggaagaatttgtggaggggagggcacaggctgaaattggcccattcctacacatgctcttgacctagacctagagtaagtgacattgaccccaaccgtccccctacccacctccagcttgtgccagacatcactaatcagtcacagcgcttctttccagctgaatccagactcagaatcctcattagagctcattgttagcacgtcttcctgaagtgcaacccatttgccattccttccctggacgaaacccaccccaaataactgggaaacccttcaaggcagtttttaatcaacacttcaattgtggaactgcatgaatccaagaaggccagctgagaagctcggaggagtcaggaaggaagaaaactaaatatccaacacccaactcttcaaagagttcaacttcctgttcaaaacagggtcagaccaggggattcttagtgaggccagtgatgagcactgtaactttaaatgcagccctgaaccccagacctgaaggcctgccagtgtcttaccctacaggccagaccgggacctacttgcccaagctgtcctactggttctgtcaaccgggggctctcaaataacagagtagaacaccacatggatatgattcctggaaaccacagaactaggtgagactcctacctctgactgcctgggtgtccttgggcaagtcagctgaccgggccatttccctcagttgtcaagtagggattagaggtgtatgtgctcctactgtgttctctgctccaaggaatcatggcgcagtgctcccagaggtgggttgtgtgttaccatgtttttaacaacgggaagcaaaaactttatttgaactttcattctgatgcttcactgatgacaccggaaatgaagataatttgttttgtgattgttttattgtgttttcaagttttaattcatgaattttcctgtactaaaacaaagagcaaagttggttaaagcctgcatgtaaataaagtccagtgggatttttgacacctgcttgacgtttctatgtctacaaacagtgttgtaatgaatacggcctttcatcattaaacattcgattttttaaaaatgaaaaaaaaaaaaaaaaaaaaaaaaaaaaaaaaaaaaaaaaaaaaaaaaaaaaaaaaaaaaaaaaaaaaaaaggggggacaaaaggggggcctcccttaaaagtttccctagggggccccaccttttttttacccacattttttgcaaaaaaggggcccctatttaaacctaatttaaagcttggcatttgcccccggttaacccgcaacgggggggaaaacttttttttggaaaatttttggaagggaccttttttcctgggggggcaacttgtggacaaaattttttcggcaaattaaaacttttaaagtatataacgaatttttgggggcaaaaaggggcaaaccattcgccaattggcaggtttgttaaaaatttttttttttgggaatattttttgccaaaagttttttccccaggccccctggggcctccaaatttttaggggcccttttaaattgccatgctccaagggccttttttagggcccccgatggtcccagagggtgggttatgaccttatttacaggcgaaacctttttttttggagtttaaaaaatcgcctaaaaaaatcccccccaaaactttccccctgtgaaatcgaaacccaagtgggagggcgaaccgcttggggagtaaaccctttttttttatggccccccttatatatgggtacacaacaatcttcccctatcttgcccacataatattcttcccatatataagcccttttttttccaccgggtggtttacacgcggagggcttgtttccaaaaacttctttttggg

SEQ ID NO: 736204 - DNA, 1181 bp, Homo sapiens; identical to SEQ ID NO: 225361

SEQ ID NO: 736205 - DNA, 939 bp, Homo sapiens
gttttttttttctgggtggcgtttcacaggatctacctgggttttattgagctgctcagatcctggggtgaggtacgggctcctgaagcgttctggagccctggctgggcaccggtgcggcccctgcagtccccactttgagtgggtccgtggcccagcctggaagctcagggctgggagtgctgtgagtcttcctttgcccagagcctgtgttttcttctagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgatccggataattccggaccgtaccagcttttttgcaacgggggggcgaggggcgtaggtggtccgggaaagacggggccgagggggaagaggaggcacaaggaggagag

SEQ ID NO: 736206 - DNA, 6687 bp, Homo sapiens
  misc_feature (5303)..(5303): n is a, c, g, or t
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgaggccgtcacaggacttgagctcctctcagctgtcaccccgagggaggcagccaccccgccccagcccaggggacactgaggttttctgaaagggttcctcccagaagcctgaggccccagggtcccagggggtgggacagtgaggccaggctggagtggcagggccagcgcgtgcaccctgccttgcctcagctgtgccagctgcccacccgggtgactgtagcgtgaggtctgaggggctgcgcccagtagctggccccttccctgcctggggttcaggctgggcccctcccttccaggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccacatggcgtgagctgaaacgtatccgtgcagaggccgggcttgcgagcagcctgggccttctcccaggcctcactgcccctccacatccttgggagtcccctactgcttctggctgagggtgccacaccccaagcctccaggtggcagtggggccctggagctgccttctggtccctgccgagtgtgtgtgtgtgttgggggggcacagccctgctgctgaggcctcccctggggcctacgtgttcaggactcagcacaggaaccgccagccatctgccagccagaagcccctcttctcctcccagctacctaaaacttcccctgcaaccacccaccctccccctgaggtcagacctgctcagccagagaacccacccaggctgagggtccacatgtggctgggggtcctccccnaccgcccagggtgtctggtctgtccccaaggctgcatgctgtcctggtggtcccacgtgtggtcaggagcccaggtccagcaggagatcagggttggctgtggtcaggaagaggcagatgcggcgggagaggtcaggccccaccctgcggggacgcccgccttcactgggcggcacaggaaggtcggccaggaggcccatgcgctcccgctccgtgctgcaggcctccagcgcctgctgcagaaggcggggggaggggaaggctgtgacaactgcatcagccacggctgggctgacccgactgaactgcctgatctgcctccgccaggccgcctgcagccctgcgccgtctcttgccactggctcgccggctgcccagcgccctgctgtgcagaaggagaaggcctgggattcccggtactgcttgaggggatactgggcgagagccttggtaacggcgcacacgtgccgactcagctcctgccaagaggccaccagtagcacgtccaggtttgcccagagctgcaggagtaccagggcctcttccacctccggccagctgacggccacctcggcaccggccaccttcgggctctctggctgctgtgtcccccgggaaacgtgctggcgagacctgagcagaggtgaccattcctccccgctccccatggggcctgccctgcccgagcttggcctctgccagagcccacctggagaagtgggatcagctgtgccacagcaaccccagaagtgtgcccacctcccctgaacccccgtcccagccagccctgctgtgggcatgagagtgagcggtaccacaggtaggcatccagcccgatgacagccaggtggggccgggcggtggtctcgggggagatccagggcacccagtgggttgggccagagatctgggtcagtgtggcgacgccctgcagaaactcctcgggctccagcagcagcagcaattcctgttcacctgcagcccacacttcaggaggcaggctgcgggggcaggggtcgggactcgctcgggtccaccgcaggctgcgggccgggcgctggggctcgatgcggcactcgcagcccagggcctccagggcctccatcaggacgtcggcaccggcgtcttccaggatggctgtgtccacgcacaccgcgaggcgcttcagcacctgctccggccgcagcagccgcaacgcctcggcagccgccctgcgctcacccgctgggtcccgggctctcgcggcggcctccgagccggcggagtcctcagcgtcggagtctgagatctcccaggttggaggtcgccgctgaccgctcccgccccgtccccggccccggccctggcaagagacccccgccctcccgggtccaacccgcgccat

SEQ ID NO: 736207 - DNA, 4930 bp, Homo sapiens
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaaaaaaaaaaaaaaacactcgaaggcatttatgtccgggtggcggaaaaaaaaggaaatgaaagggccccctggttcctaagcttgtttccccggacccaagcttccattggaacaaaggggggtaaaaactgacccgattttcccataaagtggaagcgccgatcatctttcccgaaaaacgccaggtgtaacccggccctttaataggaatcgccctctacaatcacccgggggaattctatctcccgccctttaagtagcgcggtgtctgtttctttttttagcaactcaaaaggcaatctcttcctggaagatacctatacctgactatggagaaaaaag

SEQ ID NO: 736208 - DNA, 4575 bp, Homo sapiens
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctcatacgcgatcctctctgctaacatgctgccctcacgtagttatctcgatgtcatgtg

SEQ ID NO: 736209 - DNA, 6254 bp, Homo sapiens
  misc_feature (4857)..(4857): n is a, c, g, or t
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcacccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccacatggcgtgagctgaaacgtatccgtgcagaggccgggcttgcgagcagcctgggccttctcccaggcctcactgcccctccacatccttgggagtcccctactgcttctggctgagggtgccacaccccaagcctccaggtggcagtggggccctggagctgccttctggtccctgccgagtgtgtgtgtgtgttgggggggcacagccctgctgctgaggcctcccctggggcctacgtgttcaggactcagcacaggaaccgccagccatctgccagccagaagcccctcttctcctcccagctacctaaaacttcccctgcaaccacccaccctccccctgaggtcagacctgctcagccagagaacccacccaggctgagggtccacatgtggctgggggtcctccccnaccgcccagggtgtctggtctgtccccaaggctgcatgctgtcctggtggtcccacgtgtggtcaggagcccaggtccagcaggagatcagggttggctgtggtcaggaagaggcagatgcggcgggagaggtcaggccccaccctgcggggacgcccgccttcactgggcggcacaggaaggtcggccaggaggcccatgcgctcccgctccgtgctgcaggcctccagcgcctgctgcagaaggcggggggaggggaaggctgtgacaactgcatcagccacggctgggctgacccgactgaactgcctgatctgcctccgccaggccgcctgcagccctgcgccgtctcttgccactggctcgccggctgcccagcgccctgctgtgcagaaggagaaggcctgggattcccggtactgccttgaggtgatcctgccccccttcagccttggcatcacgcacttgaggggatactgggcgagagccttggtaacggcgcacacgtgccgactcagctcctgccaagaggccaccagtagcacgtccaggtttgcccagagctgcaggagtaccagggcccagctcagacaggccctcacctcttccacctccggccagctgacggccacctcggcaccggccaccttcgggctctctggctgctgtgtcccccgggaaacgtgctggcgagacctgagcagaggtgaccattcctccccgctccccatggggcctgccctgcccgagcttggcctctgccagagcccacctcccctgaacccccgtcccagccagccctgctgtgggcatgagagtgagcggtaccacaggtaggcatccagcccgatgacagccaggtggggccgggcggtggtctcgggggagatccagggcacccagtgggttgggccagagatctgggtcagtgtggcgacgccctgcagaaactcctcgggctccagcagcagcagcaattcctgttcacctgcagcccacacttcaggaggcaggctgcgggggcaggggtcgggactcgctcgggtccaccgcaggctgcgggccgggcgctggggctcgatgcggcactcgcagcccagggcctccagggcctccatcaggacgtcggcaccggcgtcttccaggatggctgtgtccacgcacaccgcgaggcgcttcagcacctgctccggccgcagcagccgcaacgcctcggcagccgccctgcgctcacccgctgggtcccgggctctcgcggcggcctccgagccggcggagtcctcagcgtcggagtctgagatctcccaggttggaggtcgccgctgaccgctcccgccccgtccccggccccggccctggcaagagacccccgccctcccgggtccaacccgcgccat

SEQ ID NO: 736210 - DNA, 5871 bp, Homo sapiens
  misc_feature (4474)..(4474): n is a, c, g, or t
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccacatggcgtgagctgaaacgtatccgtgcagaggccgggcttgcgagcagcctgggccttctcccaggcctcactgcccctccacatccttgggagtcccctactgcttctggctgagggtgccacaccccaagcctccaggtggcagtggggccctggagctgccttctggtccctgccgagtgtgtgtgtgtgttgggggggcacagccctgctgctgaggcctcccctggggcctacgtgttcaggactcagcacaggaaccgccagccatctgccagccagaagcccctcttctcctcccagctacctaaaacttcccctgcaaccacccaccctccccctgaggtcagacctgctcagccagagaacccacccaggctgagggtccacatgtggctgggggtcctccccnaccgcccagggtgtctggtctgtccccaaggctgcatgctgtcctggtggtcccacgtgtggtcaggagcccaggtccagcaggagatcagggttggctgtggtcaggaagaggcagatgcggcgggagaggtcaggccccaccctgcggggacgcccgccttcactgggcggcacaggaaggtcggccaggaggcccatgcgctcccgctccgtgctgcaggcctccagcgcctgctgcagaaggcggggggaggggaaggctgtgacaactgcatcagccacggctgggctgacccgactgaactgcctgatctgcctccgccaggccgcctgcagccctgcgccgtctcttgccactggctcgccggctgcccagcgccctgctgtgcagaaggagaaggcctgggattcccggtactgccttgaggtgatcctgccccccttcagccttggcatcacgcacttgaggggatactgggcgagagccttggtaacggcgcacacgtgccgactcagctcctgccaagaggccaccagtagcacgtccaggtttgcccagagctgcaggagtaccagggcccagctcagacaggccctcacctcttccacctccggccagctgacggccacctcggcaccggccaccttcgggctctctggctgctgtgtcccccgggaaacgtgctggcgagacctgagcagaggtgaccattcctccccgctccccatggggcctgccctgcccgagcttggcctctgccagagcccacctcccctgaacccccgtcccagccagccctgctgtgggcatgagagtgagcggtaccacaggtaggcatccagcccgatgacagccaggtggggccgggcggtggtctcgggggagatccagggcacccagtgggttgggccagagatctgggtcagtgtggcgacgccctgcagaaactcctcgggctccagcagcagcagcaattcctgttcacctgcagcccacacttcaggaggcaggctgcgggggcaggggtcgggactcgctcgggtccaccgcaggctgcgggccgggcgctggggctcgatgcggcactcgcagcccagggcctccagggcctccatcaggacgtcggcaccggcgtcttccaggatggctgtgtccacgcacaccgcgaggcgcttcagcacctgctccggccgcagcagccgcaacgcctcggcagccgccctgcgctcacccgctgggtcccgggctctcgcggcggcctccgagccggcggagtcctcagcgtcggagtctgagatctcccaggttggaggtcgccgctgaccgctcccgccccgtccccggccccggccctggcaagagacccccgccctcccgggtccaacccgcgccat

SEQ ID NO: 736211 - DNA, 6324 bp, Homo sapiens
  misc_feature (4927)..(4927): n is a, c, g, or t
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccacatggcgtgagctgaaacgtatccgtgcagaggccgggcttgcgagcagcctgggccttctcccaggcctcactgcccctccacatccttgggagtcccctactgcttctggctgagggtgccacaccccaagcctccaggtggcagtggggccctggagctgccttctggtccctgccgagtgtgtgtgtgtgttgggggggcacagccctgctgctgaggcctcccctggggcctacgtgttcaggactcagcacaggaaccgccagccatctgccagccagaagcccctcttctcctcccagctacctaaaacttcccctgcaaccacccaccctccccctgaggtcagacctgctcagccagagaacccacccaggctgagggtccacatgtggctgggggtcctccccnaccgcccagggtgtctggtctgtccccaaggctgcatgctgtcctggtggtcccacgtgtggtcaggagcccaggtccagcaggagatcagggttggctgtggtcaggaagaggcagatgcggcgggagaggtcaggccccaccctgcggggacgcccgccttcactgggcggcacaggaaggtcggccaggaggcccatgcgctcccgctccgtgctgcaggcctccagcgcctgctgcagaaggcggggggaggggaaggctgtgacaactgcatcagccacggctgggctgacccgactgaactgcctgatctgcctccgccaggccgcctgcagccctgcgccgtctcttgccactggctcgccggctgcccagcgccctgctgtgcagaaggagaaggcctgggattcccggtactgccttgaggtgatcctgccccccttcagccttggcatcacgcacttgaggggatactgggcgagagccttggtaacggcgcacacgtgccgactcagctcctgccaagaggccaccagtagcacgtccaggtttgcccagagctgcaggagtaccagggcccagctcagacaggccctcacctcttccacctccggccagctgacggccacctcggcaccggccaccttcgggctctctggctgctgtgtcccccgggaaacgtgctggcgagacctgagcagaggtgaccattcctccccgctccccatggggcctgccctgcccgagcttggcctctgccagagcccacctcccctgaacccccgtcccagccagccctgctgtgggcatgagagtgagcggtaccacaggtaggcatccagcccgatgacagccaggtggggccgggcggtggtctcgggggagatccagggcacccagtgggttgggccagagatctgggtcagtgtggcgacgccctgcagaaactcctcgggctccagcagcagcagcaattcctgttcacctgcagcccacacttcaggaggcaggctgcgggggcaggggtcgggactcgctcgggtccaccgcaggctgcgggccgggcgctggggctcgatgcggcactcgcagcccagggcctccagggcctccatcaggacgtcggcaccggcgtcttccaggatggctgtgtccacgcacaccgcgaggcgcttcagcacctgctccggccgcagcagccgcaacgcctcggcagccgccctgcgctcacccgctgggtcccgggctctcgcggcggcctccgagccggcggagtcctcagcgtcggagtctgagatctcccaggttggaggtcgccgctgaccgctcccgccccgtccccggccccggccctggcaagagacccccgccctcccgggtccaacccgcgccat

SEQ ID NO: 736212 - DNA, 4857 bp, Homo sapiens
cgccggagccaatgggcgcagggggcggggatttgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccttgacccccaccttggcagaccctgagggcagctgcctggcctgacggggcgcagtgaggctgggaggggtgggggtccctgtggggggtgatttcccagtcggtttcctgagatctccctcggaccagagcaggagtgtggctgcgcctccctgccccacttccagctaccacaggtcatgtgccctggagcagtctctcctggcctcgcagggtcatggctgtgggacgcgggcgtgtccacaggccaggccagtgtctgacacacgcatgctgcttgtcctctgtcaccatgggccgtgtccttccggggcggctgcttgtgtgacctggtgctgctctctgctgtcacagctcccctgcgctgctgttccggctcagccaggtgtcctgggaggggtgggctcctctcctctgagtgaggactccctaagcccggtgggtccattaggccttgggggcaaattgggaaacagggtccttacccaccgggtgggggccgtcctgaggtctcctggagctccctgctccagccagggagaggcccccacctgccttcccgcccgcctccagctcctgcaggtcacatgcctgagcctcacaggctcgtggctgtgggatgcaggcgtgcctgcgggctcggcagtgttcgacacatgtgctgcttgtcctgtgtcaccaaatgggcctgcagtctgttgtgggcaggaggtaggcagtggcttcagtctttctccttctccagggaacccggccctgggcctgcagtgcaggtgctcagttctgtgcccgggctcctgactcagggggtctaccctggctctggggacccgcacttctaggcagtggggtagagttgtctgggcctgccttgtctgtggggtggggccatcccctccagaaaggacagtgtcctgccctgaagctggctttcgataggtccacgttcacctggaagctggtggcgcccatgtcatggtcccctgtggcttctcctggggatcacatcatctctctggaccagccctcaaccctcactgtcacaaggcctctgccacaggccccccgccaccacttagcactctccctgctgaccccctggtccattcagcccctgggtggcccccacacagtctgtgacagggaggaggctgggaggggcactgcctcccacaaggagctcacgttctggtgggaggaggccaagaatcaggaccaaggagaacttcagtgaagcaaaagaagaaaaatggaacaggggtgaaggggctggagaagcctcagggaggtgacagctgaaacctgcaccaggaggggcggggcctgtagtgggcactgggcagtaggaccctgtggtgagccaggtctgctcaggtaacaggaaggtcgttgggccacagtgtggtggggactgccctgaggccgggtggctgcagctgggcctggtgtgggggtggtggccttgcctgggggcccctgcagggctggcctagcagggaaggtgtccacaccatctcagctctgggcaggtggggtggacctggggcttatccaccgtctagaaaccacttggaggccaggcagccttggctactgctctgtggctgggcctccagggccctcctggtcatgcagaatggggcagagccggagcccgttgggagggagcctgggctgtgcgctcggggtactgtgaagtccctggaggcctggacccccatcctttcctgggtgggtcagggacagggtgggacagggacagagggcaagggtgagagggtagagagcgggcaacaggtagtaacagccggcccttctctcccagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaaaaaaaaaaaaaaacactcgaaggcatttatgtccgggtggcggaaaaaaaaggaaatgaaagggccccctggttcctaagcttgtttccccggacccaagcttccattggaacaaaggggggtaaaaactgacccgattttcccataaagtggaagcgccgatcatctttcccgaaaaacgccaggtgtaacccggccctttaataggaatcgccctctacaatcacccgggggaattctatctcccgccctttaagtagcgcggtgtctgtttctttttttagcaactcaaaaggcaatctcttcctggaagatacctatacctgactatggagaaaaaag

SEQ ID NO: 736213 - DNA, 3689 bp, Homo sapiens
  misc_feature (7)..(7): n is a, c, g, or t
gtaccgngtccggaattcccgggataaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagacggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtgggtttgggaattggagctcctccaaggagctcctcctaagattgagtgctgcagctgtagtggctgctggttgggagagtaagtgccatcactaatttaaaagtccttgccatctggaatcaggctttgtcaacagcagctgagaaaagcagcctgtgcctctgctggccaggcctaggccctcgtcagagcgtgcctctccacaaggcacttgggcctgggtgattgttgcgcctctggctttggcgtttcctctttgcagcactttgcctacctcccccaagccctgagccactgcctgctggggctcctactgaggttctggaaacacctctgcacctgccgcccctgggaggaaagagggccacacaggaagtgtctgcagggagaggtggcactcggcagcctgagttcaggagaggtgcttggagcttcaggcagaggggccttcagaggagggaaacggagcaatgtgtcacaggcaggcaggggcaggactgccaccccaggccccgtgggaggcctgctgagggcacagagctgctcggtgcagccttcatgctttgatctggaaagagcagctgtccgcaggcctctgtctccaagaggcctgtcacacaggaggaccgctggaaacataccaacacgtgcagtctcccctccaagctattcatgctgtttgtggaatctctctcaaacataagtgtcaggtgtgtgtcgtcccaacgggtcctgtgctgtgaatagatccatgtgcagcacaaagggaatgtggcacgtggccccaggaagagttcacccggccagggggcagttgttcagttgcctggggctgacactgaccactggcctctggggtgtcctgcagcccaaatgcccaccttgccctcctcacatctcagtcaggggaggccatgcccaagccaatgtgctgtcacagcctgcagcgggggcagcacttcctcggagggcctgggaggtgctggggatgccccagcgcttctcttcctgcctcgccctggcatggcccagcgcctctaggatcaacttacgatccgtggagcagccccgggaaacccaaatctggctcaggacagcgtacgggcaggagggctgtaaatcatcccaggctaagcctccgtgggcactggctcctgccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgtttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaaagagaaaaaatgttatttttactttctggaaaaaataaatattctcattgttgtagaaagaaaaaaag

SEQ ID NO: 736214 - DNA, 1750 bp, Homo sapiens
tttcgggagccttaaccctccgggagccgtaccctcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgtttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaaagagaaaaaatgttatttttactttctggaaaaaataaatattctcattgttgtagaaagaaaaaaag

SEQ ID NO: 736215 - DNA, 998 bp, Homo sapiens
cagtggagtagcatgaatgactccatgtgacagtctcctttaatgattgatattatttttgagtcaggcataggattgcttttggttattcacaccacttctctattatcttcacacagataataaaacattgattcagatagctgctttaaactataaaattctaggcccatggcttggccatgtcttgtagtcctagcacctaggacagggcctgacttccagtgggttttcggtcatgtttgttggctggaacagaaccaccctaagatgatatgttattggttaagagcctacaagtggactgcttaatttttaagctgggttaatatgatctaaacaatattttttttggcatgcatgtaatgtaagaaaaaagattgttattattttgaaaacaaactgaaaactgaaaaccattaaacagatgtagttttgctccagacacattgccaaaaataatgtaaatagtgtaaattgtgctgaaatgggaaggaaaggaaacaaaatctaaagggagagaaacattacagctagaaagcaaagttattttttagaactattatttctgttgtgaccttttcttcaagttaactgataatacacagtgagttgctttttctaatacagaaacccgtggcattctaggagcttatttataaccccctgcgaggagcaggcagtaaggaagaaagcttcattatgcattttaaacactgtgcttcgtgtggtcagatgaaatgttattctgcttgcactgtggtatcttttacgtctgagcaaacatacctggcttactttccccaacttccccctctcttttttctctgttcaggaaatcaatttggttgaatttcttgtgtagggtgaaatccatggactcgtacagagttggtgagtgggccatcaatgggatctctgttagctcatttttcatcagggagatacatttctttcccaaagctgtgatctaggagagttgccaagcagctagagtt

SEQ ID NO: 736216 - DNA, 819 bp, Homo sapiens
  misc_feature (13)..(13): n is a, c, g, or t
  misc_feature (16)..(16): n is a, c, g, or t
  misc_feature (20)..(20): n is a, c, g, or t
gagcttctgagtntgntgantggtaccgacagggcctgacttccagtgggttttcggtcatgtttgttggctggaacagaaccaccctaagatgatatgttattggttaagagcctacaagtggactgcttaatttttaagctgggttaatatgatctaaacaatattttttttggcatgcatgtaatgtaagaaaaaagattgttattattttgaaaacaaactgaaaactgaaaaccattaaacagatgtagttttgctccagacacattgccaaaaataatgtaaatagtgtaaattgtgctgaaatgggaaggaaaggaaacaaaatctaaagggagagaaacattacagctagaaagcaaagttattttttagaactattatttctgttgtgaccttttcttcaagttaactgataatacacagtgagttgctttttctaatacagaaacccgtggcattctaggagcttatttataaccccctgcgaggagcaggcagtaaggaagaaagcttcattatgcattttaaacactgtgcttcgtgtggtcagatgaaatgttattctgcttgcactgtggtatcttttacgtctgagcaaacatacctggcttactttccccaacttccccctctcttttttctctgttcaggaaatcaatttggttgaatttcttgtgtagggtgaaatccatggactcgtacagagttggtgagtgggccatcaatgggatctctgttagctcatttttcatcagggagatacatttctttcccaaagctgtgatctaggagagttgccaagcagctagagtt

SEQ ID NO: 736217 - DNA, 1200 bp, Homo sapiens
aattcatgcttcagattggttcataataccatttccagaaatgtattccatggggattacaaagaatctaggtgtgtgttggggggcacctacagtcaaacaaattcagaaaattgtggattaaataaagcaaaatagtattctgtaggactactgaatactatggtatattgggactctccattgggaggtaattttatacagcatctcctcaacttatatgacaaaataactcactttctgaagcatcttaacagacatttcagtgaataacacattggaaaatggtgatcttttgtgctttctgtcaggttttgatatcatggttatgctggcctcaggaatgatgaaactattagaaatctgtcttcttctatacactagaatattttaaataacgtgggggtggtctgtttattgaaggtttgatagaattcactcataagagctttttggtccagcattcctttttttgtgtgcgtggaaaggggtatagatctttgacaatctttccatttatttcatggtaatggttagattcagttttcaaccataatattgaccgttttcataatattgaccgttttcatatatgttcattgcccttccctgaaacaggattatatttccctctcatgatgtaggtttggccatgtgactggcaatgtcccagctaggggcttttctattagcttggattcaggagtaaagtaaacatggagcagagcaatccttgacctataatggacatgtagcccccaggactgggaatgactaccacagcaagtcatagccaatctagattaacacgtacatctggctgggcgtggtggctcaaacctgtaatctcagcactttgggaggccaaggcaggaggatagcttgaggctgggagttcgagaccagcctgggcaacatagtgagaccctgtctctacaaacaaaaacaaaaacaaaaacactgcatacatcctcatgagtaaattttggtaatttgtgttttccctgaaaattatctatttcaggtagatttccaaatgcattggtgtacagttgtacttagcataatttaaaaatttctgtaatggtggatagaaacctctctctcatttgtagtcttgtgtgttttctcttcttattacttatttttatcggtattttcaaataaacagcacttggttttatcaattttacttcctct

SEQ ID NO: 736218 - DNA, 1588 bp, Homo sapiens
cacaaaacagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcacaaggggagttttttattttattttattttattttattttattttattttgagacagagttttgctcttgttgcccaggctggagtgcaatggcacgatctcagcttactgcaacctcgatctcccaggttcaagtgattctcctgcctcagcctcctgagtagctgggattacaggcgtgtgccacgatgccaggctaattttttttgtatttttagtggagacggggtttcgccatgtcggccaggctggtctcgaactcctgacctcaggtggtccgcccacagcctcccaaagtgctgggattacaggcttgagccaccaagtctggccaaggggacttttaagggggctggaaatggtctccattttgattgtgaggtggtggctacaagattgcatgcatttgtcaaactcatagaactgcacactgaaaagagtgaattgtactgtatgtcaattatacctaaataaatctgacttaacaaaaaaataaaac

SEQ ID NO: 736219 - DNA, 1483 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggtgagtatccctaaagagcaggggtcgcagtctaga

SEQ ID NO: 736220 - DNA, 1844 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaaggtgagtggaggggcttctagggaaggaacaaaagaggcaagaaaaccatgcagcatcaaggtggcaggagccttaaaactgtaatccagccttctttacagatgaggaaactgaggcccagaaacaaggactggcccaaggacatgcagctagttggtggcacagccagaactagaatttggatcccctgcatcctagcccaaagctctctccctgtataccctagaagcca

SEQ ID NO: 736221 - DNA, 727 bp, Homo sapiens
  misc_feature (6)..(6): n is a, c, g, or t
  misc_feature (609)..(609): n is a, c, g, or t
  misc_feature (624)..(625): n is a, c, g, or t
  misc_feature (722)..(722): n is a, c, g, or t
ctcggnctctaccttgtctgctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat

SEQ ID NO: 736222 - DNA, 3566 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtactggcctcccatcctcccctccattctagcctcccccatgccagagttcaaggagctgcagtggctgctgccctggaaaggcccaggccacggtggcctccttcccactgactcagagaagaagctgtccatctgcaaggaaaggcccacccctgccttggggcactcacccttatcccttttgctcagagaggccagtgtcccatgcccctcctctccctccctggcacagctctttgtcccatctgcatgtgtacccttccattctgatttgaagcataatctggcactcctatcttga

SEQ ID NO: 736223 - DNA, 4708 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcagactccactcccactactggttcctgcttctgttcctcaacaccctcagatcctggggtcccaggtcccaggagccctgactctttcgaacctgttgtctctgccctcttcccatcagattctaaaccccgcctaactcacagttggtctccgaggccctccacctt

SEQ ID NO: 736224 - DNA, 6961 bp, Homo sapiens
  misc_feature (121)..(122): n is a, c, g, or t
  misc_feature (233)..(236): n is a, c, g, or t
  misc_feature (406)..(406): n is a, c, g, or t
  misc_feature (683)..(683): n is a, c, g, or t
  misc_feature (948)..(948): n is a, c, g, or t
  misc_feature (977)..(977): n is a, c, g, or t
  misc_feature (1042)..(1042): n is a, c, g, or t
  misc_feature (1067)..(1067): n is a, c, g, or t
  misc_feature (1271)..(1271): n is a, c, g, or t
  misc_feature (1320)..(1321): n is a, c, g, or t
  misc_feature (6843)..(6843): n is a, c, g, or t
  misc_feature (6858)..(6859): n is a, c, g, or t
  misc_feature (6956)..(6956): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggattgctcctgactctgatgggcatcctcactcctcagacatttccaatctcccccacttcactgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatccnaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaaaaaaaactgagttttacccatctttataaatgatgctacactactaaactgtgatgcatttgacatctgtcattcntctgtggctgaccanncatgcaacattctttatattttgggcacttcattactgtgagaagcttaagaccttctttccacccgtgaacataagggggccacatacttggtttnccaat
